United States Patent 12,790,634 (MOST PROBABLE NUMBER ANALYSIS OF HETEROGENOUS POPULATIONS) - sequence listing, part 45

SEQ ID NO: 29 - DNA, 7559983 bp, unidentified (residues 3,779,993-5,669,988 of 7,559,983)
  source 1..7559983: mol_type = genomic DNA; note = Eisenbergiella tayi
tgagaaatttctttatccaatactttacgcctccaataataaaatcaaatcgtttacctattttattatagacgtatgttaaaaaaatgtcaatgaattagttcacttgagggtgcagataaaaaaaccgggtgagagccgccgtgtccccagcccctgccgtccgcccgtgtgtgccgtggccctgcaaggttccttactggggacgctttcgctcggataagcacgcagcggtactaaggctgcaaaagacgcagcccaaggaccggcgcgcttatgacgccccgtacaggaatccttgcagggccacggcacacacgggcggacggcaggggctggggacacggcggctctcacccggtttttttatctgcaccctttacttgacagtgtgttatttcaacggtaaacttgtaaatgttcagacgagaataataagttaaagaggtgtttcgatgatactatcctgtcagaatataaataaggcatttcatgaaaaacaggttttcaaaaactgctcctttcatatagaagatcacgagaaagctgctatcgtaggaattaacggggcaggaaagaccactcttctccgcattattgtcggcgagttggaggctgacagcgggcaggttgttttcggaaaggatacttcttatggttatctcgcccagaatgcggagacggacggtgagaatacgatatatgatgaactgctggaagtaaaaaaggacgtcatcctgctggaagaaaaaatccgcagctgtgaactggaaatgaagcatgtggagggcgacgccctcaccgccctcatggaacaatacgcgctttatacccatcagtttgagcaggcggacggctacagctataaaagtgaaatcactggagtattaaaaggactgggatttaccgaggaagaattttccaaacaggcctccaccctttccggaggacagaaaacccgtgtcgccctgggaaagcttctgcttcgcaaacccgatctgataatactggatgagcctaccaaccatctggacatgtcttccatcgcctggctggaaaactatttgctgaattataaaggggctgtgctcatcgtttcccatgaccggtattttctggataaaatagcctctaagatcattgaaatagacggcacggaggtctctgtcttctccggtaactattccgattatgcggtaaaaaaagaacagctgcgtgccgccagatggaacgcctatatgaatcagcagcaggaaataaagcatcaggaagcggttatagaaaaattacgttcctttaaccgggagaaatccatccgccgggccgaaagccgggaaaaaatgcttcagaaaatagacgtactggaaaagcccacggaaaccagggcggatatgcgaatggaactcactccgcgtattatgagcggcaatgatgtcatgcaggtggaaggcctggcaaaagccttcggatccgaaaaactgttcgacaatctttcctttgccttaaagcgcggcgaacatgtggcaatcatcggtgataacggtaccgggaaaaccactattttaaagatcattaacggccttgtggaacaggatgccggtgaaatcaaactgggttccaaggtacatatcggttattatgatcaggagcatcatgtgcttcacccggacaagaccttatttgaagaaatatcggacgaatatccgactctcacgaatacggaaatccggaatgtactcgctgccttcctctttaccggtgatgatgtattcaaacagataaaaatgctctccggcggggaacggggacgtgtttccctggcaaagctgatgctttcggaagctaatttcctcatcctggacgagcctacaaaccatcttgatatcatgagcaaggaaatcctggaggatgccatcaacagctacagcggcactgtcctctatgtttcccatgaccgctattttatcaaccgcaccgcgtcccggattctggagctggaaaacggttcttttaccggatatcttggcaattatgattattatctggaaaagaaggcggaaaatactctctctgttccggaaacagacggagcatttcctccgtctgccggaggaagcagggaaggcaatccctcttcctctgccgcttcaagcctgaaacaggactggcagtcccaaaaagaggcgcttgcagcgcagcggaaaaaggaaaatgccctgaagcgctgtgaatcagaaatcgaacgtctggaaaaacgcagtgtggaaattgatgaagaaatgacgcgtcccgacgtatgcactaatgttgcaaaactgcaggaattagccagagagaaagaacaaatcgaagaaaatcttctgcttcagatggaagaatgggaaagcctgtcggattaaatccggcaggcttcattaatttctgtattcatgtacaatttggaactcatccgttattttcaggctttttctcgataaatatctttctggtaataaaattataaaccatgacaactgctgtcgccgcaattttaaccagcatgtaggagcgttccatatactgatccagccaggaggttcctccccacataattacctggttgatgccaaggccgataatgctgagaataaggaatatgacaaattgcttcgccttattcgcttccttgtctgcatcgaatacaacggtaatgctcaggatataattcacaatcaccgaaacggagaaggaaattccgctggaaataacagaggatatcccgcatagttctgtcagcgcaaccatgatgccataatcgataaaaaagcacaaaaatcctactactccaaattttaatatctgttgtatcagttttttcatttttcttctgccccttacttagtgttctaaagtaccagcacgtaatactgtaacacctttttcgtaaggaatcaagccgttgtttttatcgaaatgcttcatctgctgcgattccgtccgcaattccgaatttagacatttgtgatatcagctttttcataggcagactacaggatagcttccagctgtttacggatagctccgataaagtcctgactattcagtacagtaacatccctcagagttgtaatctgagccaaatccttagtcatcacaccattttcaatcgtagcaagcgttgccttctccagtttatctgcaaacttctccaattccggaatggcatccagttcgccgcgctttctcagagcacccgtccaggcaaaaatagtagcaacaggattagtagaggtttcttcccctttcagatatttgtaataatgtctctgaacggttccatgagctgcctcatattcatagattccttccggtgaaaccagtacagaggtcatcatagccaaagagccaaaggcagatgaaaccatatcgctcattacatctccgtcataattcttgcatgcccatataaacccgcctttagccttcattatacgagcaactatatcgtcaataaggctatagaaatattccagccccagttcatcaaatttttctttatattcctgttcatatacttcctggaaaatatccttgaaggtatgatcgtattttttggagatagtgtccttggtaccaaaccacagatcctgctttgtactcactgcatactggaaacatgcccgtgcaaaactggtgatagatgctttggtattatgtacaccctgaataatgcctgcgtccttgaagtcatgaatagtttctctggatacattcccgtctttatcagtaaatacaagttctgctttaccggctccctctattttcatttccacgttcttatatacatcaccgtaggcatgacgcgcaattgtgataggcttttcccagttcctgacacaaggctcgatccctttcaccacaataggagcacggaataccgtaccatcaagaatggagcggatcgttccgttagggctcttccacatttccttcaggttatattcactcatacgggcgccgttgggagtgatggtggcacactttacggcaacgccgtattttttggtagcttctgcagaatcgacagtaacctggtcatttgtttcattcctgtgttccagcccgagatcatagtattctgtcttcagatccacaaagggaagcagcagctcgtctttgatcattttccacagaatccgggtcatttcatccccgtccatctctaccaaaggtgtgttcatcgcaattttattcattctttacatctcctgttccgcccgggtctcatccccggactcattttcttcataagcctcgtagagtccgcttttaaccatgttctggtaagccttgcggatatgggcattcgcgagctgttcggccagatccgcatcacgcagcttaatcgcctccataatctggcggtgttcagcattggactgtacgccccgggcgtcatccgataatgtttttttcctgacacgcagtacatattcatggaattctctcagcacatgctccagcattttgctgttggatgcttcatacagaatgtcatgaaaacggttatccagctccgccagctgctcggcatggccttttccggcatggaattcggataagtagatgttctcttccatctcctccatctgttccctgctgatgttctccgtcgcccatctggcgcagagtccctccagcagagagcggatggcataaatatcctctacatcctttaccgtaataccggtaacataggctcccttgttcggaactatctgaagcagcccttccagctccagctggcggaaggcttcccgcaccggtgtgcggcttacgcctaattcatctccgatcgcagcttcccgcagttcctcgttttccttgtatttcccgctcaggatatcctccctgagcttatgaaagacacggccccgaagggaatacttatccgtgacttcattttgaacagaaggatggcccgcggagcgcggcatcctttgttttgtatctttgtcacccatattttacctgtccagctttcctgccgcgtttttttggctgccgcccaagcttatgccaagtttttcgcaggcgttatcaattactttaatcaattcctcatccgtcagtacagttacacgtccgccggcatattcttcgtccacccagtcctttacctcatgcaccagttctgaggttttgcttacctgatcctcttccttcagacggtaataggtattgatccagtgggcgatacccgcaagtccggatgtattggataccgcacagataacaggcctgtttaaaaacttctccgtatcaaatatattataaatctcttcatttttcaagaggccatccgcatggatccccgctcttgtcacattgaaattctttcctacaaagggggttctctccggaatatggtatccgatttccttttcgtaatactccgccagctccgtgataaccgtagtatccattccgttcaagtcccctttaagctgtgcatattcaaataccatggcttccagaggcgtatttccggtacgttcccctatgccgaacagagacgcattgacaccggagcatccatacagccaggccgtggtggaattggataccgctttataaaaatcattatggccgtgccactcaatcagggcgtggggaactccggcatgggtatgaatcgcataaatgatgcccggcacgcttctgggaataacggctcccggataatttaccccatatcccatggtatcgcaggcacggattttaatcggaatcttatattccttcatgagcttcatcagttcgagacagaagggaaccacatagccgtaaatatccgcccgggtgatatcctccagatggcatctggggctgattccttcctcaaggcattcccggatcacactcagataatgctccatggcctgccgtctggtcattttcagcttcatgaagatatgataatcggaacagctcaccagaatacctgtttctttcatgccaatttccttaaccagcttgaaatcctctttgctggcacggatccaactggtcacttcagggaactggtagcctctttccatacatttatagacagcatccctgtcctttttgctgtaaaggaaaaactcacaggcccgtatcattccattcgggcccccaagccggtgcatataatcataaatatccacaatctgttccgtggtatagggagcgcgggactgctggccgtcacggaaggtagtatcggtaatccagatatccttaggcatattgtgaggcacaatcctgtcattaaaaggaatcttcggaatctccgaataaggaaacatatttctgaaaacattgggtttctcgacgtcatccagtatgtacatatgctcttctatttccagaagattgtttttgtcattcatgcttaccggacggtttgaaaaagtttcattcgaattcatggcacctctccatttctcaggccctcagaagaaacagtcatggacttccgcttctctttcggatacctacttatagtttatcctttaatccatgtataattgtatacaattatacatgttgtgtcaatatttttttaatatggctgttccgaaaatccttatatccaagaaaaaacggatgcccgtgttcagcatccgctatttcctgatttagagatttattataaaatatagtttccatagtcaagggtaacatttccgtttgcgtctttctgtgtaaaacgtaaagaatgatatctctcaaaaaaacaatatgtattttcaccagtgatatcgttacgaaaactgttaaaaccatcctcatccagtttcttgcatacttctccatgggcatcgccataaatctcgccgttttcttctttgccgcacacccaacccactccaatattgctttcagggaggtctatggaggcatacccctcgggtaccgcagcatcagcagggaaaaacagtccgatccaatatgtgaaacctgtcattattcatccattcgtcccactgcttaccgaagctacccgcagaatctctgtcttcgtttgtatagcaagtaccaataaaccgcaatgcagggaaatgttccttgtagacttttgttatctcgattgacatatttttttcctccagttcaaatcttatcagccatgcacttcacaaaactgctataaatatattccttaaatcgcagtccccttttgggggacaaaaagggaggacatatccactccttccagcttaagcagctgtatttttttatctattcccgccgcataaccggtcaggcttccgttggaaccaacaacacgatgacagggaataatgatggagatgggattatgccctaccgcacctcccacagcctgtcccgacatacccggcctgttccttttttccgcaatcagctttgcgatatcgccataggtaatcacgctgccatagggaatttggcagaggattttccatacctcctgcctgaattctcctccggcaggagcaagcgggatttccgaaacagctggttttccgcctgcaaaatagttatccagccatttccttgtctgttcaaaaacaggaatttccttattttccaccatctctcccgccatggtatttccatggtatttttgtccttctatccataatccggtgaggttattgccgtcagaagccagtgtaagcatgccgacaggcgatgaacaggttgttgaataatacatagcaaacctccttttttacaataaattgcaagtataatgattatatcacaaaacaccgcagcaaaaaaggaaccggttatcagttttatccggtccctttctgtatttctgttatatcatgctgttttcacctgagtgaacgtgccacattcagcataccccagccctgcttgctccaggattctcccaaatcggatgcagaccacagaatccttcgtttcagctgttcattggagtattccggatatttctgaaggcacagcgcagctgctcctgccaccagcggcgtggacatggaggtgccgttttttacaatataggcatctctgcagcctcttacggtctggaggaagcctgcggaacaggacataatgtccgtccccggtgcgacaatatccggtttttttaattccgcgcaggtggggcctctgccggaataggattcacaggaattctgcctgccatggaaggaattcccgtcatgacagcctactgtcaccaccttcctgctggctcccaaaggagaaatactgccggcggcaggtcctttattgcctgctgccactaccacaaaaataccggcatcccataccttctccaggcaggacaccagatactgcatcattcttacatgatcggtttctcccatgctcactgaaatatttaatatctttatttgataaagctcccggctgtcaagaacccattcaataccggcagccatattggaaatagtgccatctcccttatcatccaggactttccccgacaggatcctgcatccgggtgcaactccggcgtacaggccgcccgaacaggctccgtttccgcacagacatccggccacatgagtaccatgaccgcagtcatcgtagggcatgcggctggttcccacaaaatcacggaagccgataactctgtctgcaaaatccggatgcatggctatgccggtatccagaattgcaacggtgacgccggagccggtgtagggaaatacctcttcttcttccgcatgtatcagttttttaacccggtccattgctttgtatgtttctttctttttctattaaagtatgtttggggcaggtggtgggtgaatggagaaccctggaaggaagactccgatattccataaaacgaaagctgttttcccataccagaatcaataattaaaaaaaattttattatcattggaaacactgacatgctgtacggcatagtataaaccataaaaaccaatttggaggcaaataaacatgagtgatttaacagcaagcggctgcggatgcggcagcaataccggttgtggcaccagcaacaccggctgtggttgtacaactaactgtggcgggagctgcggatgcggcggaaataccggcactggaagctggatttggattctgatcctgctttgctgctgcggcggcggaaatagctttggcggcggaagcggatgcggatgcggagattccaacggctgtggcggaaactccggctgcggaagcatgatgtggattctgattctgctttgctgctgtggcggcggaaacggcttctgctaatgtaactgcgcccatattgggcacatacatgaaaataggctctgttacagagcctatttttatgttcttatgtttccggcgccgacatagtatttctatgaaagggaaaaggaccgggatatggagaagaatgataaagattatctacagacctttgatgctctgtatacaaccaaccaaatacaaataatgaaaatcctcctgccctactgcagtcccgacagccgcagggggctggctgtcatgattaaattcatggaatttgactacactctccgtcttacccgttcacatcctgaaagttttcgggatgaggcaatccctttttccttaagtgacatctgtgacaaaataaaaaattactgtcctccccaggtacgttccatgctcgaacagttccagtccatacagaatgccatgcagatgtatgaggaaatgaaacagtatatggatctatttcagggaatgagtacaaatgaggcagatggtactgcagctgcggacagcggcagcggccctgttccggaagccggacaggacaataaagaaaaaacaggcggcaatcccttcggcatgaatccaatggatatggtgatgggtatgctgtcccccgagcagcagtccatgtttcaaatgttccagtcagattttaacacagaagcggcttccacagataatacgattgcgcgggacagcccgccggaaggagaacaataattatggcagattatacgggtgcaaataattcctctgaaaagcccaaatggatgcaggagccttctttgaagggcatttccatggagaagcttgattttttacaaaagatggtttttgaaagcagcagcctttcccagaaagagctcatgccctttctcatggctcttgcccagaaaagccgggcggcgaacattacttttacccaggaggaaatgacggccatcattgaggccataaagaaatacagcactcccgaggaactgatgaaaatgaatcagataatgaaactcatgcagcagcgtaagaaataatatggcaggggcaggaatctacctgacaaaatataagggacactcccaaatgctgactcagcgcatcgggcggtgtcccttacgtatgacatacttctgattttatccggtttattccacagcggccactttatccgaaagctccttcaggctttcctcggaagggacatactgtatttttacaggatccataagaatatggaatttgcatgcctccagctccgcatttaccaggcccgcgctctgtccgccccagccataggaaccaaacgcaaaagcttttttattcttcggggccaggcctttcatataacaaaggaaagaggctacggtaggcagcatctggttgttcatcgtaggcgatcccaccgcgatatactccgccttcaaaacatccgtcatgatatcggatatatgatccaccttcaaatcataaagcttgacaggaacgcccttcatggcaaagccttccacaacagcccttgccatcctttccgtggaatgccacatggaatcaaaaaccaccaccgcctttttatcgggtgtttcatcgcagtaatgcttataggcctttatgatatctccaatgtggttcctccacataacgccatggcttggcgcgatcaggctgatatccaggccttcaatcaccggtatggtcttcttcatctgcataccgtaaggcatcagtatattggcatagtacttctccgcttccgccataacctccgccaaatccacctcatcatcataacgtttgctgctggagtaatgctggccgaacgcatcgtttgaaaaaaggattttctcctccggacaatatgtaaccatattatccggccagtgaagcatcggagtcggtacaaactgtaacgtatggcggcccaggctcagggaatcccccgctttgaccggcatatattcatagctgtcgccataatgcattttaaggccgttcagcccgctgggcgagctggtaacaataacagcgtccggagccgcctccatcactgcgggtatagcgccggaatggtccatttccacatggttggaaaccagatagtcaatccgggcgggatctataatttcacggacacgctccagaagctccgcggcaaaaggtgcttttacggtatcgatcaatgcaattttctcatctacaatcaggtaggcattataggtagcccctctgttagttgtgtaaccatgaaagctgcgtacattccagtcaacaacaccgaccgcataaataccgggtcttaattctgtggtattcattacttatcctcctgtttttcatttcgatctatccgatacttttttcatatccggatctgtttaaatcgagtacattataactcagttttttcttcttgtatacttttcccggataagtattctttttaatacaaaaacaggccctctattctgtttcctgtgcgttcgctgtttctgctgccgtttcttccgtatcctccgcagatgttgtctcttcctcagtttcttctatgaattcctcaggttccttatcaaaagctgtcaccacataggaactgattccatacacctggtcatctccctccaggcgtatataataatctcctgtcagatcattctggttccccacatatataattatgccggaaccgttctccagcgttgccttaatggtccgtaccggattatccaggccatactcagaaaggtcctccggctgctccacaacggattccgtggtaataccggcaatattattcacaagggaactgaccagggtttgattcaaaggcatttccctgtcatccgtattcacccatttatcttcctcttttgcaaaattcagcctgtgatcaccgcttacggaaagtgaagtaacatccttagatgcaaaatccgtcaccgcaacctcctccgcagcagtatctttctccgaaaagtccatacttttgaatatgaggtaagctgccgcacagagaaggcacaatatgagcagtattatcagctgtattctctttttcttcatcagcgtttcctcctttccatccagacaaggatcccggctatcagcaggcccaacggaagaagcagcataaacagggcgcccagtgtaaaggcagtaccgtcattgatcgtaatcatggaagcctcataagatttcacaggcactgaaacactctctttactgtcggacatggaagccaccgtattggtaaacagcgtaaggttggcgtccgcaaccatggaattggcgttatccgtaaacagattttccgaagtgaacagtgtcagtccggccgttccttcttccagcttcttttctgcatgtatacccacatcaaaaggcccttctgcatctccgtcttccttttcatagttctgagcctgattcatattgagtttggaataagaagcttccgaactcgtaagcagaggcgtcagggtcacatcctccttttcctctgagcggattccctgtgcataaggcataaatatatatttttcccctgatatgcccttcgtcagcatatcataggccacatcgggcagcagataagcgggctgctggtaatacatggaagagtctccttccataacaagccctttttcaatggtcaggccgaaataatcaagtaccttctgcagattgggcatttcctccgcgaaatcttccatataggcggtcgtcatgagaattttaccgcccttatccagataggcaatgagtttatccgcgtcatccgcagaaatatccgtgacaggcgccatgatcagaactccctgcgcatcctccggtacgctttcctgtgtaagcagattgatggactgcagctgcgcattctgtttttccagtccattctgaaaagccgtggaaagcggaagctcatcctggccctcaagggtgtagaacaccggcatatcctcactggttacatatgccagtgcgcttgttatctgcccttctccgtcatagcctgtcacattgctgctgtaggtggtataatccacctctgtttcgtaaatatcattataatcgatgactttgaaacgtttgccgctcaccactatcagggaattcattccgatatttccgtcgctgtaatccttataaaaattcggatttacaacaggatccttatactccacatgaatatgcccggaaagatccgtataacgatccagcgtctgcttcagcgtggtatcctgcttttcttccgactgaagcacatagacagtgatgtcctccgtcagatttttaaccagctcctgcgatgtctttgtcagcgagtaaagcttctgtgatgtcatatcaaatgtggtaaagcgggacggcagttcggctgccgccagattcagaaataccgccgcagccacggccacggctatcattcccgtactgtaggctcccatctgcaggctcttcacagacacctggtatcttctcttttgaaccgactgtacggtaaaaaacagaaatacaagaatatatgtaaggaaatacaatacagatttcaattccatggagccctgcatcatatcttccaggcggcttgtcatatcataaacattcaaaatccgggtgagcagatttcccgtggaagaaatcagtccggttatactgcccatcatatatcccagaaaaagagcgccgaagctcagcaccgcagcgattacctggctttctgtcacggaagaaataaacaggccgatggcaatacaggtcaggccatataaataataggccagcagagccgtatagctctctcccatggatacggcgccgaatcgggacaggatgagaggataagccgctatcaccagtgtggaaagggtaaagatggtggccgccgccagatatttgcccaataccaccctgccgacggataccggggaggtcaggatcagctgatctgtcttctgcctcctttcctccgacatcatacgcattgtcaaaataggaatggtaatcagcagcagaaataaaatgttataaatcgtattggccaggctggaatacccaaaccgaagattcagtgcaaagaaatacaggcctgacaaaaatatattcgcagcaaggaacagccaccctgtcatagaatgaaaataggctttcagttctcttttataaattgctttcattattcgtttcctcctgcgctattttcttttcctccttttttctggaaaaatggattcctttctttgtatgtgcctcttcctcttcttcattcgccgcattcattttttcagagtccgtaagctccaggaaaatatcctccagcgatttggtactgatatgcatatccagcaaaggcagcttttcttccgataaaagatagaaaagaggttccctgatatccacatcttctccggtttttatgatcgcttttgtctggtcttcagacactgcctccagcctgctctcctctatttccccgattttctccagaaccgacagcagcttctcctgtgttccctttacggtaatttccagctccgcctctcctgtcatcagccttgtcagcccctccggcgtatcacaggccaccagttttcctttggaaataatcaggatcttatcacagacggcgcttacctccgaaaggatatgggagctcaggattatggtatgcttatttttcaggctctttatcaaatcccggatttctataatctgcttgggatccagtccgacggttggttcatccagtatcaggacctccggagaacctaacagggcctgggccagcccgactctctgcttgtaccctttggaaagattgcggatcagcctgcccctcatatccaggacgcgggtcatcttcatggcctcttccatacggtcttcccgttctttggaaggaattcctttaagctccgctgcaaaacgcaggtattcctgtactgtcatatccggataaacaggaggcatttccgggagatagccgatacagcgcttggcctcctccggttccttcataatgtcatgtccgtctaccttcacttctccggcggtgggcgccagatagccggtaatgatattcatcgttgtggactttcctgcgccgttcggcccgaggaatccatagatctgtcccttctctacctgaaaagaaagatcattcacagcataatggctgccatatttttttatcagatgattcacctctatcatcttctatcctccttgcaacatttttaagccgactctactgataaactgttataaatgtattccatttttgtgtaaaaatgttggaaaatatgtgatttttctgtgaaaccaggtttcctcctatagcagggcagcaagaaattaatgactgggccacaacaaaaaaagcccatcggagttgtttctccgacaggctcttcataacctctataccatgggtttaaggttttgcaactatattaataattttaccgggaacataaatttccttaaccactgtcccgctcagcttgccggcatcttccagagccttccggcctgccgctatcgcatcctccttgctgatatcaaccggtacagtcaccaccagctttgtcttgccgttaacctgtacggcaacttccttttcatcgtccgccatagcttccttatccgctaccggccatactgcatggaatacggaatctgtttctcccagctgccgccacagctcttcaccgatatggggagcgaagggagaaagcataacaaccgccgttttcagggtttccttatcaataccgccgtttctcgccatatcaatcatcttgttggtgtattccataaagccggaaaccacggtattcagactgaagttttccagtctggtcgtgatttcatggatcatccggttgcgtaccttgagcatttccttgtcagcctgtacgccgctgtccttattatccataaccagattccagaaacggttcaggaaacggttcacaccgtcaatacccctgtcatcccattcgctgtccagttccggaggacctacgaaaagctcatacatacgcagggaatcacagccgtaatcccttaccaaatcatccggagaaactacatttcctttggatttactcattttaataccattcttaccggtaatcataccctggttgaacagcttgatgaaaggttcatcaaaatcaaccacgccggaatcatacaggaatttggtataaaaacgggaataaagcagatgcagtaccgcatgctccacgccgccgatatacatatctacaggaagatacttatccgccttttctctgctcaccagttccttatcatttttgttgtccacataacgaaggaaataccaggaagaaccggcccactgaggcatggtattggtctctctcttggcaggagcgccgcagacaggacaagtggtgttcacccaccagtcaatatccgccagcggagattcacctgttccggtaggctgataggactccacttcaggaagcagcaaaggaagctgatcctccggtacaggcacacagccgcactccggacaatgaacaatcggaataggctctccccaataacgctgacgggagaatacccagtcacgaagtttgtaattcaccgttttatggccgattcccatcttttcaatcattatcggagcttccttcttcagcacggcgctctccatgccgttccattctccggaattgatcatggttccgcttgcttccgtataagcctccgtcatattttcaatttctttcccatctttggcgataacctggatgatcggaatatcaaatttcttcgcaaactcaaagtccctgtcgtcatgggcgggcacgcacatgatagctcccgtaccgtaatctgccagtacataatcagacagccagatgggcaccttggctccgtttaaaggattgatggcataggtacctgtgaaaacgccggtcttttccttatcctgaagcctgtccacgttggatttcatggaagcatcgtaaatatatttctctactgcgtttttattttccggcgtggcaaggctggcagccagactgtgctccggagccagtaccataaaggttgctccatgaagggtgtcaggccttgtggtatagacagtgatcttttcatccctgccgtcaaccgggaaatcaacttccgcaccgtaggacttgccaatccagtcggtctgcatcttctttactttttccggccagtccagcttatcaagatcattcaggagacgatccgcataagcggtgattttcagcatccactgcttcaggtttttcttggtaacgtcagctccgcagcgctcacacttaccgtttaccacctcttcattagccaggcccgttttacaggaaggacaccagttaataggcatttccttctcataggcaagccctgccttgaacatctttacgaagatccactgggtccacttgtaaaaggaaggatccgtagtgttcacttccatatcccagtcatacaaagctgcgatctgtttgatctggcttttaattttcgacacattgtctgccgtggaaattgcaggatgcactcccattttaatggcatagttttctgccggaaggccgaacgcatcccatcccatgggatggataatgtaatggccgccgttgagcattttgtaacggctccacacatcggaaataacatagcctctccaatgtcctacatgaagtccgtttccggaaggataggggaacatgtccagacaataatacttgggcttctttccatcattgacgtttacagggttagtttcccattctttccgccatttttcttcaatctctctgtgattgtaaggtgctgccatagcttcctccttttttactactcttatatttttccatttatggggataacaaaagccctttcttctgcttagagacgaaagggcttcttttccgtggtaccactctaattcgcatcatggtgcccgaaagaaaaatcccttcctccgcagcctgacgcgcacttatgattctgtaacgggaactcccgctccggactacttcctttttcaagtggttcccccggaggactccaaggcgagttggggatttatccttaccgcctcacaccacccggcggctctcttaaaaggacagaatccttactattcctcttccatgtctttgtcttattgctattttgccgggaaatgcagaaaatatgccattttcccggaaactagggataattttatcctttttcccggcttttgtcaatagtgcctttcttctaattcagctcctgtaccggattcaggccgccttcatcgagatatttgatggtaatccggtcacctgctttaaaacggacgattccgatgagcttatcattcgataaatccacgtcaaaaatattttcatttccttcaatacagatataataatgagtagttccttccagaactataggggaaatggattcaatcctgccggaagcttcctgataggcatccgtgttctggctcacaattccgttcgtactcagcagctcattataactcttctcacattgctgaatggtatccccgattgccacccactggtatttctgcacatttaccatggcatatttcttaacgaggcccgccgcatccttcagcgccataaaataggtcggctcatccgcaatatttaaaagcagggggaaggaagatttataccccagattctgtacctgcccttccgccgaagacatggccgacatctccgtagcgccttccaccttataaaaacgggtttccatcgttctctggttcatcagtacaaaacctacattggactgatccccgttaacggaggtaataccggtatatacccagacgtcatcatccagagcgatatagttatatccattggtggtcaccagacagtccttctgtcctaaaacgctgttaaaaaatccatgctggtatattccatgataatcatacagctgcatcagcatctctgcggaatacaccttgtctatccactggggaacatcctgtatgtcataatccgtacattctccggtaatagcattacagaggacaacacgccctatggtaacgcctccgaaaagcccgatattaaatttctttacaggacatacccagtagggaacaccttcatcatcgatttcaaagaagagctgatccccgaaaatataggtggggaactgaaaacgcagatggcggtacagatttcggttaaaatattcggatttggaatatttgattccctcctccagcattacacattccgtatcctgtgttgtcatatcaatgcggatatacgccggaataccatttttctgattggtcagccacttgacaggactcgcatatacaagcggggtaactcttacaggcactccattgtaattaagctgggtataatcatccgccacctcaaactgggaaacgatatctaccaggctgcccatcttacgatcgcccagcagcgctgcggagtccttatccagaagcggtatcgtccgataatccacttccttaatgtcatccgtaaaattcctgttttccagcgccagcagctgctggtatttctttgcatttatgatgggtgacgacaatatgcttccgataatatatgcagccaatatcagcagcagcagaatccccatccacttcaagggtttatattccttcaggctgagcttcaaggctacggttcctgagcccgccatgtcttttcccgccttgcggatgacatacaggactatcaccacgacaatcgctgccatgataaaaaaccagaaaccactggaatgaatattaatggccggcagcgtaacataataatagataaacgcaacaactgcggccagaacacccaaaattgtgtataatacaccttttttcatataaaataatactcctccctgccggtcttccattccggcaatccctttcgtcagcctgtcccggcctttgaaaccggactgctaacaaattaattcattgtaccacattatcccatctatagcaatgcctggtctgcgcccggagcgcaggacaaatggggctgcagccaggtactttgcccttgtttctcatctttgcgcatgataaaatatataggaacaaatcacaaaagaagggcagataattcgattgaataatcctttagtttctattattattcccatatataacagggaacagacgctggagcgttgtctttgcagtatcatcaggcaaacctatcccaatctggaaattatcgctgtcgatgacggcagcacagatcacagccgcgttatccttgaacgttatgaaaagaaagatccccgtctgcatgttatttacaaaaaaaattccggcgtgtcggaaagccggaatttaggactgcagatggctaaaggggatttcgttcaatttgtcgatgcggatgactggcttacccgggacgccacttctcttttgctgcaggcaatggaacctgacatacagctcgttatttctgattattaccgcgttataggcagacgaatctggattaagggccatatccccgcatccagctccatgagccgggctgaattcgccaaatatatgatgaaatctcccgccaatttctattatggggtgatctggaataaattttaccggatggatatcatcaaagaaaatcaattgtacttcgcacacgacctggactggtgtgaggattttaaatttaacctggaatacctgaagtatacttccaatgtccaagttctgactacgcctttctattattatgtaaaaacaaagggaagcctggttgacagcaaaattgatctcaaggagacaatacgcaccaaaaaaattctgttcggctactataaggaactgtatcagatcctggatatgtatgaagagaacaaattgaaaatacagagcttctacctggaatttgcccgggacaaagtcaaagctcccgtattgccggaagctcctgttttgccccgtgccggaaagtacaggcataaggaaaagtaactgttaatcctgcttttcgtaaaggaaccgttccggcagctgtaaatggaaggataccgccagatcacggaaattatccggtgtaattgtctgaagcttatccggtttcatggaaagaactttaatcagaatctccgccgatttttcaatggtatgcatcagcccgaaggtcaggtcaaaattttcaccggagcagaacatgccatgatgagcccagatgaccgcatcatatttctccattaattttccggtttccagtgcgatttcccttcctccgggaaccatccatccaataacgccgactccatccggaaaaaccacagggcattccgtagccatctcccacagctctcttgtgaaaatttcatccttcaggggcagaacgaaggtgagcgcaatcacattcgtagtatgcgcatgatatatgactctgtgttttccgctgctcactctcttctttacttcatggttcattaaatgggtaggcagctcactggtcggcccgccgccttccaccaatccccagcggatacaataattttcccctttttcatctatctctattatcgcaatgcaggcttccggatccacgatgatattacggaaatacttgcccgttcctgtcacaaggaaaaactccccggcaaggtcgggaacctggactccaataggcgtccatacactatgatcattcaggcggttcctgatgctctccacctctcccggcttgatccgataggacaaattgccgccgtttcgttcatgccagccttcccggtaaccatcatccgccatcttaataaaatccttcacaaatttagattccaaaaccttcataacagtctcctttcctgcttcccgaatattgctttcttttcactctttttctgtaagcatccttatcatacacccaaatcatttataaaacaacatatattgtgttgtttttgttgttttttatcaagatattatattatttttatgatgtatttctttttttgacaaaaaaagaacctgcaaaactgtgcaggaaaagttcttataataaaaagggcgccgaagatatcccccaacatcttcggcacccttaccccaattttgcttttcttctctaaaaaagactttattcttcgcttccttctgctacttttgccgctctcgcagcaacttccttctcctgaatatcggaaggagcctgctcataacgggcaaatgcaaaggaataatcacctctgcctccggtcatggaacgcaggtccgtacaatatccatacagatccgtcataggcacatcagcctccacaatctgctttccgcctgcgataggagtcattcccagcacacggccccggcgtttgttcaaatctcccataacatcaccggtgtactgatccggtaccgttaccttaagggatgcaataggctccagaagaaccggtccggcatccataaatcccttcttgaaagcctggatggttgccatcttgaatgccatttccgaagaatctacagggtgataggatccatcatacagaatcgctttcacgccaactaccggatacgccgccaacggtcctttctgaacggattcctgaattcccttttccactgcaggataataattcttcggtacagcgccgcccacaacctcctgggcaaattcataaggcttctcaagatcacctgaaggttcaaatttcatcttaacgtggccatactgtccatgtccgccggtctgttttttgtacttatattccacatccgatttcttgcggatggtttcacggaaggcaaccttgggctggctcagttcaatctccaccttatattcattaagcagcctgcttaccacaatgtccagatgctggtcacccataccatacagcagtgactgatggttttccgaatcattaaccactctcagggttaaatcttcatgagtcatctttgtaagggactgtgaaatcttatcaatatcccctttgttcttggctttatatctcttggaagtataaggaacggaaatttccgtcttgccgtattcaatgggtgtgctcttggtagacagggtatttcctgttctcgcgccggtaagcttggccagagcaccgatatctccggcatgaagctcactcacctcaatcggcttgcttccctgcatcacataaagctttccgattttttcttcaatatccttatcataattaagcatctgatcgtctgttttcaggacaccggaacaaactttaatcagagaatacttgccgataaaaggatccacaatagtcttgaagataaaagcactcttcgccttagcaaaatcaaaattcgcctggaaaatttcctttgttttcatattgataccggcatattcccgtccctccgggctggggagatatttaacgatatcgtcaagcagggtataaataccctgtcccagaatattggagcccatggacatgggaacaatggttccgtcatcaatattggtacgcagggcggctctgatctccgcttcggagaaggattcgccgctgaaatatctttccatgaactcttcacttgtttcagcaactgcttccatcaaggtgtcacggcaaatctgaaggttcggtttgttgtattcgggaatctcacattccacaacctccttgccctgccatctgtagccggtctcggaaataacattgacatagcccacaaacttctcattttcacggatgggcagatggaagggagcgattttcttgccgtaaaggctggtcatgtcttccactatctgacgataggaagcattatcaatatccatatcggttacgaataccatgcggggaagcttatatctgtcacatagctcccaggctttctgggtgccgacttccacaccggccttaccggaaataacaatgatggcggcatccgcagcgctgaccgcttcttccacttcacctacaaagtcaaaaaaaccgggagtatccaatatattgatcttcacaccttcccattcaatcgggacaacagatgtgctgattgaaaattttctcttctgctcttccttaccaaaatcgctgactgtatttccgtcagttaccttacccatcctggatgtaattccggacaaatacgccattgcttctactaaactagtcttgcctgatccgccatgtcccagaagaacaacgttacgaatcttgtctgttgtgtaaatgttcatactgaattcctccgtattatgcgatttccgggttttctgtaaaagtccccaatccactcaaaatctcttccagaaccccatgggtatattttactaaatgtcgaaaatttttacaagcaattttcaacattttatacaagttattttttatcatctttttccagcagctgcatccaagtcagacaaacctctgaaagccccggaaatcaaggaattttagccaaatctaaaaggaaaaggtgggctgtacgggcgcagataaaagaactgagtgagcggctccgtctgcccgggctccccctcctgttcttccagacgtcctgcggctcggtaaggttccttacagggcacgctcccgctcggacaaacacgcagcggtactaaggttgcaaaatacgcaacctaaggaccggcgtgtttatacggcccttacaggaatccttaccgagccgcaggacgtctggaagaacaggagggggagcccgggcagacggagccgctcactcagtttttttatctgcttcgttccgattgactttcgcgctttaaagtgctatattaatatctgcatcaggaatacgtaaaaggaaaggaacgaacccatgattattgtaatgaaaccacaggccgcggaatccagcatcacggcgataaaggaatatattgaaagcagcgggctgaatgcccatctttcccagggtaccgaggttaccatcatcggcgtcgtaggggacaaaagccgcctgtctaccgaaaatctgataagcttcaaggatgttgaccgcattgttcccgtgacggaaacctacaaacttgcaaaccgcaagttccatcccgatcccactacagtaaaggcaggccctgcctccatcggccctgacaatatgaccattatggcaggcccctgcgctgtggaaaccgaggatcagctgatgctcatcgcaaaggccgtcaaggcatccggagccacgatactgcgcggcggagcctacaaacccagaacctcaccctactctttccaggggctggaggaagaagggctgcgctatatgcaggaggccggaaaggaaaccggtctggctaccatctgcgaggtagtgagccgggaagccattgaagctgccgtaaaatatgtggatatgatacagatcggcgcacggaacatgcagaatttcattcttcttaaggaagcgggacgttccggccttcccgtactgctgaaaagagggctcagcgcaacgatcgaggaatggctgaacgcagccgagtacatcattgccgaaggcaatcccaatgtggtattatgtgaaagagggatacgtacctttgaaacctccacccgcaataccctggatttaagcgccgttccggtattaaaggaaagaacccaccttcccgtcatagtggatccgtcccatgccaccggtgtttacaaatatgtagcccctctggccaaggccgctgtggcctgcggcgcagacggactgatgatagaggtacataatgacccggcccatgccctttccgacggtccgcagtctctcacctttgaaaaattcgaaaagctgaccggggagcttgccccttatatcagtctcgccggccgcagtttcaaataaaaggagcaacctatggaacaacttactttttcctttttcgggcttgggctgatcggcggttccattgccagagccatcagggcttcccatccggactgttttatccgcgcctgtgatacggacagctcaacgctcaggctcgctttagaggaaggcgtcattgatgaagcgtcggaacgtatcgatgaagaaaacggaatggcctttacggattgtgactttctattcttatgtgccccggtctcccagaatgacagcaatctgcgtctgatacgtaaatttctgttatctgaagggcgcactcattccaactgcatcctcacagatgtgggcagtgtaaagagcactatccatgccagtatagaagaactggggctgacgtcctgttttatcggcggacatcccatggcagggagcgaacggatcggttttcagaattccaaggcatctttactggaaaacgcctattatatccttacccccactccggatgtttccggggaacaggcggaacggtatgccgctctggtaaaggcgatgggggcaatccccctgatcctggattaccggcagcatgattatgtgaccgccgccataagccatctgccccatgtcattgcctcctcccttgtgaatctggtaaaggccagcgataacgaggacggcatcatgaagctggtggctgcaggaggatttaaggatattacccggatcgcctcttcttccaccgtcatgtggcagcagatctgcctgacgaataaagagaacatttcacagcttctggaacgctatatcagttctctcgaaaaggttaaggatgaaatcgacagaagcgatgcggcgcagctgtaccatttttttgataccgcaagaagctatcgggattccttcattgatgcttccagcggccctatcaagagggtttacaccatcaatgtggaaattccggacgaagccggctccctggcttccgtggccactttgctggcgctgaatcatatcagcattaaaaacatcggaattgtccataacagggaatcggaagatggtgttctgcgcatcgaattttatgaggaagcctcaattgaaaaagcagaaaagctgctgggcagcagaggctatatggttttcctgaaaaaataatactgcctttcataaaaagtgccggctattgaatgagccggcgctttttattatatatgggtgataataaactccccttctccttcaagaaggaatttctgtcctccggcaggaataaaaatgctgtctccggcctttatatccattctttccgttccttcctggtttttcagcacggcatttccccctacacacaataaggaatagaaagaattcccgtcttcctccagggaataggtgccatgaagcgtacagctgacacattcaaaatatttacacctgctcaggatgcgaaggagcacatcctccgtttctatcgtttcgctgtcaaaccgctgtacttcgtaacggctgtaatccatgaccgccagagctttctccatatgaagctcccggtaatttccatacttatccttacggttataatcatataaccggtacgtacagttggagctttgctggatttcacagatcaggctgccttttccgatcgcatgaaccgtgccggccggaatgaaaaaggcgtccccctgcttaatggggatacggttgagcagggaaagaatggtattctcttccaccgccttctctacttcttccctggtcacatcccgcttaaagccgcagtatatacaggaatccggatcacactgcagaatataccacatctcattttttccatactcattctccttttccagggcataagaatcgtccggatgcacctggacagacagattttcttttgcatcaataagcttgaccagaagcggaaaacgctccagcggctggcatttccagccccatttctcttttccgatccgatccagatattcggagaaaagaagccccttgtgcctaccggaagccacgatgctctggccttccttatgcgcagacagctcccagctctcggcaatgatttcataatcacattttttgccgtatatatcacgaagcctggtgccgccccagagatagtccttaaaagcaggcagcagacggacaaaaggctcgacctgataaccaagctccgcttccgataaatcccggctgcgtatggaaatcaagtccctttcctctaccatcgtacctgtggaaatctccataaaaacaagaggctcattcccgatattggaaatctggtgggcggtattttcaggcacctcaatgctgtcatttgccccatactccctttcgctgcctttcaggattattctggctctgccgcatacaataatccagtgctcggtacggtgtgcatgctgatgggcataaatagtctttccctccgtaaccaccaccttacggacaacatatctgggatttacattcaggagctcataagtcccccacggcttataaataatccttccctgatcaaagtaatgctgttcctccggattttccttcataatacccttaagcttctcagactcccccgtcctgcctacataaacggcgtcctccgtattgattatcgtgatattctccagattattggccaccacaagctgacggtcactctgattcagcacggtggtattggtgctttcatacacgatctgattccggtcatccctctgaatccctgtcatggacagatcctccagacttccgatatcctgccaccggaaggaactgtgaatcacctttcccctgcccgtcttttcaaacacacttttttctatgggaactgcctggatcccctcaaggacctccgaaggataatacgtgtgcctgccttttaccttacgcatataaaaagcggcttcacaggaattataaagccatggataaaatttcctgatttcctgtacgagagtccctacccggaatagaaacattccgctgttaatcagataatcccccgcctcaaaataagaggctgccgtggccgcgtccggcttctctataaaagaaagtacctcatcatcatggcaccggatatacccgaaccgggtttcaggtttgcggatatccatcccgaaggtgacaagccagccgtcccttgccagctctgccgcccgtgtgacatcgtctttataggtaggcccttcaatcagatgatcgcttgcaacaacaaacatcagctcagacaaagggaactgcagacaggaaagcacgatggccgccgtagtttttctcccgacctcctccagcacaagcctgtaggtaataccctggaaggccttcatctggttttccacgataaactgatattctttattagtaactatgataaactcatcgcaatagggaatattcctggcaatcgtctcctgaaaaatggaatgatccttctggatgctgataaactgcttcggataatttttcctggacaacggccaaagcctgtcgcctcttcctccggccagtacaagacatttcatatgcaccttgctcctgtatcttctttataagaaatatgcggtaaaatccctgtgaaatagtttgtccgcatatctaatactatagccgaaaccggaggatttcacaagaaaaaagaacggtgcatgccgttcttttttacgcgtgcccaacgggcactcattccatcttcagttgtcttttcctatccgtttttctttgtggctcccagcttacgggacttgtcagcgccaaggtagtctttttcttttgaacgtcccaacagataatccgctgatacattatagtagtcacaaagcaacgggataaacctgaccggcatcgcattctgccctcgttcatatctggaatagactctctggtcaatattcaggtattcggccacctccctctgctttacatcgttgtcctctcttaagccacgcataataactacataatccatcatcatttgcaccttacttccaaaatttaccaaacttcgtttttttcagtttagcatattccataagcaagaattgctttttccactgaactgtagtagtattttagcgtactttttccatgatgactataaacgataggattggatatattgaatagcaaaagatgtgccatatatggcacatccgacaatacccaccgggtcaatccgttaatctgcacaaaaaaaatgaatatccattactgtataaaccttaatacaaataggcaagggttaaaataccttttctcttattccccgaaaaatcggtatattcctaaataaccagataattctacgattaaatcattttttcttatcttttctcattcgctccgattacagacctccggcccaaaattagtactattatatcgataacttaaaagaataaaagcttcccttttttccgcaaaaaaatgcccggtttccgatgttcaggaatccgggcattttgaaaccacacaagtcgattttagaaaataattttagtgctggtccagaactatcaggttctgggagatgttgttgccggaacatcttccatatgagctcctttggctacaacaaaagttacatttacagcgccgccgaatgcaggaagtgcaacagcaaccgcaccgttcttaataacaacgggtacggcaacccatgtaccatctgctctctggtataatgcctgaagagtttccccttcacccagagcagctgctccgagaatatctgacagcgcaaacgctgcagatacggaaccattctgtgcaacagcttcgccggaagcggtctgcaggccaattaccatgttgttaacaacattcaaattgccattagcgtctgtcagagacagtccgcttcttccggtaaagttaactacctgcattttgctggaagccagtgctgctgctaaagatgctgcagaagcctgtgcctgttcagcggaagcaggtgcgataaccattgctacagcagacggatccacaatctgaccgctagcggtcttgaatgtggttccgggaaggactgcagacttatcgctggaaacacttacagcctgtgtggtaacagtattattggtaccaacagaagggcttacaacgacctgagctacaggctccttctggatggacggactgggagccgccatcgcagtcatgcccatagagcatgcgagaattgctgaaagaacaattgccattttctttttcatgtcaatcatccccctttcttatagtgtgtgtggcttctttatatcaacggccggttacccgtccgctaataccatattcaggctgtcaaaaacagcgttatggcgttacttcatcataaaagacctgaagtatcaattcgtacagagccgtgtcatcctgataaaattcctcaaaaatttctcccatctccacgtgcccttccattgtatatatgtcattctggtcaaaactataggataaagcctgtcctgccagataaactgcttcgtctgcggaaatatccgttaccatataaggggaaacctgtgtgtacagcttcagcggcagagtcatatcctgtttcatcgctgtctttgcctgcccgataaatccctgcagatattctttctgacgggacagacgggcttccgcactctgcgcctccctggtatcacggtattttatgtatacataggcttcttcaccctccaaatggacacggtctcccggcttccattcggaaccataccacctgccgccaatcttcataccgcccttggccacagattctggtattgtgacttccaccccgcctaccgcatcattgattgtgcttatgatgctcatattcagcgcgcaatagccatgaatgggcaggccatagaacaaattggaaacagcctccaccgtattctcacaactttcttccagcccttccccataagcgtgggcaagcgctatctgcgcgacctctttccccgcataaagcccgttggggtcataggttttaatttctgtcatcgtatcccggttaataccgattacacttatttttttatcctccggatccaatacggccaggaacagggcatcagcctgaccgcctctgtataaatcagaagaggccttcacctctccggttttatcaattcccatacataaaaaggtcaaaatatcctttttataggcatatgtcttcccattatagcgaagcgtacccgcttccaatgcttttcctgcatcattctccgatacggaaaaatcctgcatctgttccgggacagcctcctgtttttgagcgaaggcgctccggccatgactgtccatccaaaaatatccgattaccagcaaaagaagaaataaaagtatcaccgacagcagaactgctgaaaatatcccgactttttgagccgcagaccgccttttctttttccttctcctctttctcttctgttccatccctcatccgcctttcagggcctattccgacacaagcacagcctgtaccagataacgcttatcatcttctcctgtcacccctgtggataaggtaatgatcttatcctccgccgttacttccacggagtcatctataaaagcgtccatcgcccggattgcaaagatatcctccagatacgtggaataaactgctttatcccagaaatcataggttgcaatcaaatgacggtcatcgtaggtgtatgctgcaaatatctgataagtaaacactttgtcttccgtactgatctttacttccctgtgggaatcaaaaaagtccctgtccttatattgatgaagcctgccgaatcgttcttccctgttgcgtccgtaaattacggtattgggatctccaaaatccttattgttgtaatattccgtataaatgcagccattctcatcctcgtccccatatatgttatggctcagataaaagtactcgtcctctgcgggctgcaggatgggaaagctgatatccgtaccggtaatttccagccatgcataggcttctgcgtttatcgcctgaagcgcctgaatatccgccgtgccgtcttccttaaggaattctgctgctgatggttccgtctgttcttctgcctgtacatcagactgtgtctcccctcgctcttcccctttgctgccgcagccggtcagaagaatggcgaacgtaagcaaaatataaagtgaggaactgtgaagcagggatttatgttttttttgtttcattttcttttccttctgataattttcatagtttggcataacctgtccggaacatgccggccccgggaagcatacagagcacataaagataacacttttgatgcgaaacgctttacgccggctgctgcagaatccctccggtccataaccggaaacggaacctgcctgtatatggaaacaggctgcctcccctcttaatgattcttgtatggcttcccttattaacgccagaggcggtaacagctactgttgtacttcttcatagaaaatatctataaccatctgatgaagggcatcttcatccggataaaattcctcatatacatcacccatctttgtctctccatccagcagatagatctctccgctgaattcataagacgccgcggttgtagccagataagtaacctcatccgccttgatatccgtagtcatataaggacttaatttctgaaaaagagtgagcggcagcgtaacatctttcctgaaagctgctctggcctgctcgataaagccctgtagatactgcgcctgccgttccagcctgtgcctgttgctttcaaatacatcggtgtcccggtacttcacataccaaaaagctgtctctccttccagtctcacgttctctcccgcgccaagggcaggatccgccgccgtcaaatcctcgatacattccacctcaacgccgcctatggtgtcattgatcgtggggattccatccatattgaccgccaaatagccatgaatgggaagctgatacataagcgcggaaaccgctttctccatcagtttggcacttttatcttttccgtctccataagcatgctgcagggcaatctgggcctttaccgtaccggaataggcgcctgactggccatagacctccacatccgccatcgtatccctgttaatcgctatcaaatccacctttttatcatgaggattcataacaacaagaaaaatggcatctgcctgtcctttctgccccccgttctccacggtttccagcctgtcctttttatcgattcccataatcaggaaggtcatgatatcatcgttgtactcatagatcttatccttgtacccgatccacccctcctgccattgttccaccttatccattacgtttatgtctgtggaaatcgaaggctcctgaccgccgcccttactcataatgctgctctttcccatggcccggactaccataaaaccagtcgtacagaccacacaaaacacacacaatacagttataactgccatcaaacgcgccctgcgcctcatttgtcttcttttttctgctttttccggatttaatatcgcttccttttccaaatccgccttgcttaacttttccatcctgtatttcctgctttcttttatcctgttttgttaatgatagttccttattactttatcggcttttttaaaagtaaattaatatacgtttaaaacaggagttttgggcataaaaaaatcacctggcaccgctttccgaaaaaacagccagaaatgttttaattaaaattttaagatcaaggctgaccgaccagttatcaatatactccacatccagcctgacaatttcctcaaaatccgtaatatcgcttctgccgctcacctgccacataccggtaagacccggacggaagctaagcctctttttgtgataagacttgtaatgctcgaattcatccaatgtgggcggcctggtaccaaccagactcatatcccccttcagtatatttataaactgggggaactcgtccaaactcgttttacgcaagaatttccccaccctggtgatgcggggatcatcttccattttaaacatcagcccatccatttcattctgggccatcagctcttttttccgttcttctgcatctatatacatggaacgaaacttatacatcttgaatatacggccgttccgccccacacgcttctgcgcaaagaataccgggccgggggaatccagcttaatgacaggcgccaggaatatggtaagaatgaaaagaatcagactaccgacaacagcacctgctatatcgataaggcgcttcagcatcagctggccgaagggcgccactttatttgcataagtaatggtatggaactgtccaaactgagacagaatacgctgaggagcttccgtgagttccaggacaggaacctccaaatggatagtcaggcccatcgcagccagattttccaaatcatcttttctgtcttcctgcgtctgcctgtccgtacagaaaatcacttcatccagaggcgctgagaggcaatactcaatcagatcctttcccgaagccactaccgggattcctcccacctctttttcatcgccgtccaacaggatgatgccttttatctgatagctgtaatccttaatgttcttcatctcagttaccagagcaggcgcttcctttgcagtggccacaagaagcagctgacgggcatttcccgcaacccggtaaaataccggaaggtaccttttatacagctgatggacaaggaacatcagtaaaacatctatgaatacaaaataaaggagcacttttctggaatattcgtcgattacccttgtaaaatataaagcaaatgtagcgccggccagagtcaccagattcatcttgatgatttccagcagttcctgaaagggtccccggagcagcatttgcttgtaccagttcttaaacaggttgattacaagaaacaccaccaaaaaaatagcaatcagaactttcatatccgtaggattattcaatcctttgaagaacttctgatgcctgaggtagttagcaataccgagactgagaataaggacaaggcagtctaacgatatgattattaaattttgcagattagacttcttctggtacatattcctccggtaaagcagaaaaccattacgcttctgctcctgcgtttttcttgattctatctttatgatgtgcagtcaggtacagtatcataccgatacacagatatcccagcatgccgaagaagaaaccttccaggcattgggggaaggaatagtgtcttccttctataaagagcttcataaattctgtaaaaaaggctatgatgaacagcatggatgctgtggatagtatgcgaatctttgttgtgactttgcggaaggtgaggatgattgcccagcttccggtgaatcctaatgcgaagaaaaggatggccctgccggcttggcgcagatagtaggtgatggttagtatctgttcctgggtaggggtgcttttcagggtgcctgttacctgggttaccaagggcttttcaagggctttggtggctgggccgctttggaaggacaggtatagggttattagtagtatgaatgtaaacatggtccataggatatatggaagccatggtttggggcgaggcaattgattcatttatgaaatccttatgtaggtgaaccggtgaaacgggctatttgtattttttaagtataatatgttaaattctgttatgtcaatagctttagtagatattaagtggcaggctttatcatagatgatatgctacgatgttacagtctaagttattcaggcttttaaaactggtattttatctacgtttaatgctccatcttgcatactatagcataaatgtccggaattttctagtggtatttgggaaatcagagaaaaatttgagaattccttaacctagaaaggataggaatttcaccgaattttatttgcatccacccattcaatgcccttctatcgctattattccatccgatttatatcggcatttttaatctttcttaatagaatatgcttccaactctccgttaccgcagactaggactatacgttcaaaaccattcattctgacctcagtatagatttcacaacggccataatcatttttttaacagttcgttcgtatccaaggacttccgtatgcagtatattgaatatgataaattcaatatactgcataacatggggaattaattattctaatacttttttaacagaagctactaattatggataactaattaaaatatcgagataaatttttgtcgagataaattctgaccatggaggacgctctgtaaagaacacatcttccaacccagaatccttttactcaaaaaatagttgtattttatcctgtatttcccgaaaaagcttctggatgttcctttgagaattatcaaaaatgttcagctgtgcttcttcacgggcggaactgtcaaaatcaacggaacattcctcttttaaaatatggccatcagcgtcgaaatctccattcatctctcctgcatcctgcgccgtgttatagaaataactttcaaaacctgaatacggtacttcttctttcataaatcttctattatatgtattgttgaattccccctgttcccggctctggtgcagcctgctttccacacctgtagtgcctggttgccaatactgcttcctgttttcagggaatatccccgccaaaagagaagccagcctcttcctgcaggcacatatggcggctggttatatatcgtactcttaacccatttaagattttcctgtagttcactgttttcccccagaagataactgttctgatcctgcaaaggttcagcatgattatgctgaaatttcaagataatcatactactataatagcaacttttgaagactttattgtaacgtttatgttattttcgatgacctgtattcccaatatgctcctgatacaatttgcaaaaggcgcaacatactggattcaaaactttccgaccctgaaataatcacaattggcatctgtgggaaattggtcggaatggactcctaaaacgcctggttttcctttgttaagaggaattacaggcacttgtttcctaagctttgcaactgcacacattttaacagaacccacagattaccccttcaggtaacagagcttatccggcaaaaactgctttctattttttcaataccatgcagcctatattttgtgatagacaactttcctttggctgtatgtaaattcggaaggacacgggtactgccagtcctttcgtcagaacagcgccgactatgaaaaatgtccatctaaaaaaggatatctactttggctataaagtacatgccctgattactttggaggattttataactgcttttgaaatcactccggtatccatggatgacaggtaagggctcagagacctggtgatgtagcaatcgccccttacgattcttagagacaaaggatatataggtgaagcacttagcagggaaatgagggaacagggcatctgcctgatggcgttgaagtggtccaacagtaaaatggactggccaaaacctgtacgactgttgatatttcgactgcgcagacgtgttgagacagtatttttccagctaagcgagcagttaaatgctgaaagagtacatgccaaaaactttcaaggactatgctgcacccggttggtaaacaaagtactggcatacaatctatgtctggcattgaattacatgctcgatgagaaccgtgaaataggcaaaataaaaacagctcatcttctgattcaatacagtcataaaacaacaagggggcttttgaacttttagcaacttgcaggtctttcaattaaaagtagcacaacaagttaacttaatttcaatatatttcccaactttgcatcccactctttcggttcaaagggcatcaaaccgctgcaagggtgaaatgtcatctcagaaaaaaagattcgattatctacctgatataaatctactcgcaggaactgatgtcctgctgccaatctcgatgccaagactttcatattctcaaactgtgacggtttagatggaagttcagaaaatggcatataatcactgcgaccaaacggcgcaaattcccagtcgagtgttaaaaaactaatcgacgcaattgaatggttttccaatcctgtggatacataaaggtattcaggtttacctccaaagcaatagaacttgtagtctgtcaacatatctttccgttttgttggcttaacacataccttttgcagttgtagtttgtagtcaacagtttccggcaggtgaccattatttataagtataccccccccccgcttcagataggcaaatcaactctccaagtttcttatcccattcttctggcacaaaattagcaaatccacagtccgagaagaaagtatattccgaaaaatatacttctccatttatctcatagagatcaacccgaataaatcccgccttgccaacggcaaggtttctaacgacatccagcatcttttccaactgtttcggtttccgcaatggttcaacactatttggaaaattctgccttaaatcaagcaagttccactgtgtatcaaaatagtcaatggtttcattcttctgcttatcattttgaatcacctgaatgattttaggctctccatcaaagcagaaaaacttatataccggtaggatgcttcataggtgtgaacccacaaaatccaccccttattggcaatcagataccccctcgattgaatcgggtagttttatccattctccgaatttatagtcccattcttccggttcaaaaggtaccataccgccccaatgagacaatgtaagttctccaaaatatatctgaccattgatgtcataaaagtccacacgaacctgtggaatcccttctgatagcttgccagccagttctttcatcttctcaaaggattccggcctcttgatttcatgttctgcattcggatggccattagtaaaaggtaaatgcttgaaatccatatcgaaaaaatcaaacttagtttcttctccagccttgtagcggtctgacgcaatgaacatcgcttttgcaaagccatcgaagcagaacaacttataatccttcaactcatagccagattcgtccaccatgtactgctctgctataatacgaggttttacatccttgtatggccactctcgaccttgcatgtaataattccgttttaggctcttctccagcttttctctcgccttttttttgtcaaaagaaatcttatccctgcaaatcacaacaccgccgctgtcatgggttgttttcaatacaaactgattgggcaggctatcaaaatctatctcttcaaagttatcccacacaccaagtgttggaataatgtattcctctccaattcgttcagctacatattttttcgcctcgtacttatcaaccatagaagtatactccggttttctgtcatgaagtttcaaccactgtagcttttcgttgaatgtttgaggctgatcaagattcaatttctttcctatataaattctatacatcagcttcaaatacttaacatctgacatatgattaaatatgcctaagacttttaatttccaaagcatataatttcttacttttttccaagataattttctcatatcaccacattcaacctacacaagacttagccactgctcacaaatcgtccttgcatcgagttcttcttttattttaacagcttcctctgaaatcctatgtgcgaagtcacgattatccgctattttgcacatagccgaaactaatgcatcctcatcgttcattggaatcaatatgccatttatatctgtcttgacaaacatctttgctccacctgctgggcaatccgtaacgatagtagggattcccattccaagagcttctaacatagaattagaaataccctcaaaattggatgtagaaacatacatcgcagcttgatgaatatcttcgtgcagcttctttgaaaatcctggcagaaaaactgcattgtcaatacctgataactttgactgttccataagttcctgttgaagttcgccttcaccataaattatcagttgataatcacgatgagtttcataaaaccttttaaagccctttatcagcaacgcaaaattcttttgttctaccaatcttcctgcagcaacaattaaatgatctctatctccttcatatctctttggaagtattctgccgtctaatggattagggataatgcaactccttgcctgtacttttttactataccatgcttgagcatcaggtgtttggaatacggtccaatgtgccagtttatgaagtccaagtgtaatcataaagaaatagcctattttattcttaagtgataattcctttctaagcaatccaacgttcggatcatttctctctgacatgatgatttttttccaaacaccaatattggcaatcaatgtgtataatgaaacaacctgcataaacggaatcacataacccgccgaattattttttagaatagtatggagctgttttatccgatgaaaagctgctaattttcctctagattttatttgaattaaattaaccttatctgaaaccgaatacgctacactttgttctctaagaaccaccagtgtaacctctgcacctaaatctgcacaaccggatgctaaaatagaaataaccctttctgcgcctccagtgccaagagatcctgtgacaaaaatcaccttttttttattcatcatgcctctcctcatttaacccagtgattacctcatagtagcatcgccaacaccaaacttatgcgtcacacaaccaccgcgtcaatggttttattacattttccggcttgaaattttcactatattccaaacatatctttttcatagcgagaatctttctcggctctgtaattgcgtcttcaatgcatcgagatagagcctccatatccttcgcatgaaacaagtaacccgtttcgtcgttcttaacaatttctttgttaaatcgccaatcagatgcaattactggtaatccagacatataactttcacacacagaagtcggaaatccctctccaggataaaatgacggaaaaagcatacaaaaatactgtgataagactttcaggcaatcttcaccatttaagactcctttataagtcacatatgcctgatgcttatgaaataatgtgttgtaatgctcttcttttccattttcaatcggtccccacacatccaatgtgcattttatctttgtactagaatcattaactcttgagatagcttcaatcgcatcgtcgattcctttttcttgtgttacacgagaaaatgtgcaaaatttatacggtggttcgatatcataattaacctcgtcaacagaaatgggagttcttatcgaaaaaatggacataacatcgatattccccgaataaaatccaccaagttccagtttaagttcttctgtttccggcaaaatataatcaatttttttgatactctttttcagatatctgtgattctctagcagactggtaagccatcccccgacaacaggatatgctaactggtagtggaaaacatttttcaatgtggcaaaaaaaggtaaaacaaatttaattccatgcttgttaggcattataatgatttttttacatgaacacgcaacacgccaacattgtgaaaccagttttaccttttctgctttccaattggatgtatctacaatttgaacgttttcttctccatgatttttgcaaagctgatcatagattcccaatgttttggccatctgaccaccaataatcgggttatctgttgaaaaaccaaaataacctaccacacctattttaggcataatctttctccatttccgaaaacacatccaaagcccgtcgaattacatcatccatgtcgtagtacttgtactcagctaaacgacccaagaaaataacattcttctcttttgttgcctcattacggtatttctgcgccaaagccttccattcagcggttggaaaagtataaaatggttcatcgccatcacaaggaatttctttcagaattgttgttttagcgtgtttctgtccagtcagtttcttaaactctgtaatgcgtgtataatcataatccattggccagcgagtactggccactggctgataggactcacaatcatgggtttcaaaaataaatttgatactgcgccacttcaattctccaaatttaaaatcaaagtagtaatcgataggaccggtataaattaacttttcgtaccggataccatcaatcacttccttatagtccgtatttagcatcaccttaatctcagaatggttcagcatattcttgcacatttgcgtaaaaccgccctgcggattgccctggtacttatcggtaaagtatcttgtatcccgattttttcggaaaggaatacggctaatcaccgacttatccatctctgccgggtcaaccccccactgcttaatggtaaaatatttaaaaaatttttcgtatatatccatacccccttggctcaggacaacatcttcactagtcttaatctcatcaatctttatctttttgctctcaataaacgcatccatctcgtcttcggacaagttcatgttatatagcttattgatggtctccaaagaaatcggcatcggtacaaaattaccgtttacataggactgaactctatgctgatattcatgccatttggtatactgacaaatgtaatcaaaaacttccttatcattggtgtgaaaggtatgaggaccatacatctgaactaagataccatcagaattgtactcatcatacacattcccccccacctgtgctcgcttatctataaccagtaccttctcatggagctgcgtagcaatacgttctgccatcgtgatgcctgcaagtccggcacctactattacatatttgaatttcataaatcttttcacctttctatccagtaattgaaattgcaacctaaaagcatgctcacatatccaattcgatacgctgtgctatacagcattctttcgcggctctacaagacatactttcgtagtgactttatcttatacatcatccatacacaggcaaaggaaagtaactctaccactatccaaatcaacataacgactatccaccatcatttatcaaaagtcatcggcgtaatatgtacaaccctataaagcatatatgaacacaggacgaaccaggtatacgctaaaatattacccacagcttttctgtgttcttccttaattttaaccttatgaaacagcacaaacaaaattccagatgccacagcaatcaatggattactgtaacttagtattccgtttaggtcagtttacaaggaactacacgcagaccacgaaacgggggctactgacaacaaataaaggctgaatatcaagcaccgggaaagtgcgagatattcagcctgttttgttgtcaggggtttccaaaggggcttgccccttggcacacgactttgctcgcaaagtgtagtgtgttatacgctctgtcggcgttgctgcgaaaatgccgttgccaaccgggagggcaagggcatttgaaacggcaggaaaacagggctgtgattgcgtggcgtggagccgcaagcgcaggactggtttcatcagcagacagggcggatatgaaagcccccgtccctcgtcccacaccggactatgggacaaagtgtcccatacggatagccacacttacgaaaaaacagacggatttttctctcaaaattgaaatgggcgggaagccattttaaggctttcccgccttgattgactattagcaaagacgggcgggactgtcaacggcggcgcataaaatgcgccgttcatcttgaccgttgactggctcggctggctttgctatctccacgataaatgggatttgttatctatctgtccaagaatcgaatctcgttgaaatttgtgggtcgtatagagggcaaccaaaatcaagtaaaatatccatgagagcgttcatatcagcctcttgcataccatagcaatcaaaccttacgatttgcgaagttgtaaaaacctgaaatgctccatgtccttctttttcaaaatctttgcctccaccttgtatattccagtcagaaaaagaatcagccacttttttcaaaatctcgtcaatcggaagaacttccaatacttccattacctcgccatcacaacacgctgtctgatatacggttgaatggtcatgtgcggtatcttccttgtacttccaaataaagtgtaccccttgtcaaggacaaatttaagaagaagggatactatgttctgaatagatattgttatatttcttcttccttttctggttcatttattattcctctaagaggataatttccagttgttatatattggtaatactcatttggagatagctttgccaactgccattgatatctctcattattataataatccagccagtcatcaataattgttttaacctcttgaaagacggcgcaccggcttatatccacctcatctttcatatggccaaagaagctctcctgtggtgcattatcccaacagtttccccttctcgacatggactgtctcaatcctctatcctttactaattgaatgaaactacagcttgtataatgacagccctgatcgctatgaattatggcttcagcacttaacgacacaccgtgtttttctaccatccggtttactgtctgtagtacaaaatcaacttccagtgattcgctcaaaacataagacaatatctgttttgtaaaagcatctaaaattgtagacagatagcaaaatacaccattataagggatatatgttatatctgtcagcagtacccttctcgctccataagctgtgaattgtctttttaccagattgtctgcgacatgattggtctttattgcttttgccattcttctatatggatttgcagctcttattttacacacaagtccatactttttcatcaatcggcggatcttctttacattcataattatgggtggattttgatgtatcagcgtcatatagatgctctttgcgcccttatcatatccacgtttagcatacgctccaagaattatttcaaaatctgcctgatcttttaattccttcctctgtctttcatctgcggcccctgcccagcgatagtatcccgatcttgatactcctgctatatcgcaaagcattgtaactgataacagattatcttctttgcttactaatccgtatataatctcaaatttacagtccgattcattcatcatccgtctttctgctttgagttgtctgcttttataattttttttaaaaactcaacctcctgacgaaggtatagcagctcatgctgcatctgatctaaggatacttctttttcatgatttgagtttattcgtttcatgggaactcttttggttcgattttctccctctgtaaatccatctccagatagcgcctgcttctttactctctgcacaatgctgtctatctgtttttgttgaaacagcttagtgtcataacctaaatcagctataatctttctcggggcatctccagcctggtatcgtatccagaaatcctctttaaacctggctgtgaaatacagtttgttctttgtgacattcagggtatacttattttccttaagttgcttcatctggtttactgtgtattcccgcatatctttctcctttagatgtttttattatatatcaacatctatcagagataaagaacccccttttcaatctgtccactttggagggggcatcccttcttcatagtgtccattttcaaggaacccttcttcttaatgtgtccacatctatgggtacattataaaaaattcaaatccatactcattgtataatcctcctgttaaaaaagtaaattcaattttatcaatttcttatttcctcccccgctgtgggtttggatttttcagcaagtccgacttctccgaaatctttttgagccatttcttttcttcctcggacagcttcttatagttcagccggagccgtttgcagataaacgccagcgacgcttgctccgggtcgctgtctgggctggcagtttcctcggcggtctgcaagaaatcttccagtggattgtcctccgggacactgaaaaaatcttccttatgtgcttcccgcaggtcaagagctatcttgcttatgtcctgctgtatcacatagcggcaaaagctgtcatcatcaatatgggcggcgataagctgtcttaactgcgggtcggacaagccgggattgtactgcttcataatcgttgcactcatggtgtccacgatggcgtttgcgctctgtacctgttttcctgcgataccgtttacatagatttcaaggtcagccatcagccggggaaaatccgggtgtactgccagttcacacaagagggaattatctatcaacccacttttcaagagttcaatcatatcatcactcaaacgcaggtctgcaagatcagcgtttgggtgatttcttgtttgggacagccccagtagataatcggcggttacaccgtaaaacttcgccagcttgataatagcatagtgactgatgtccttaaaatcctttgcttcatagctgcccagcgcagacttggagagatttacctgctcctcaagctgctccagcgtcagcccacgctccacacgcaaatctttcaatcgttcttgtatggatagttccatgctctccctccttgtctgctcgataaatgggaactgtgttatcttaatcttcactcaatgttttcaacatgagttcttaaataatcaaaatattttttgccatcatcattaccgtcctcgtcaggctcaaatatctcccttccttcaaacatataggctctaagcaaatattctgtggcgtttttttcgtcccctatttctaaacaacattcacctaatcgaagcataacaaacggatttccatatccctcgccgctcaaattcccccttgctttgtcaaagcattcgtgtgctttttcgtattgtttcttttgaaaataaatatcgccaatggcagctaaaaaccatatggtttcactgtaaaattgctgtggctctgggattaggctaagagcttctttccatgcttgtatagcttcctcatattgttcttcttcctcaaactgattgcctttttgggctaattcatctaacttagtttttatttgtggtgttagttcatcaatagccacttcttcatttttcttctttgaaaacagtcccataatatacctccgtgaaatttcgatttgccattctatttcttctattctaccacaattccaagagcgtggaaatagagagttttccgggctgatttccgaccttatggatatacggggcgggcggtcttttaggtgtagacttaaggtagttcatcgatgagctgcaccttgaaaaatgaataaccgtccgaaaaggaataccccggcaggggaagcaccgcaacgagccacttcgggacaaaatgtcccgaagtccggggagcgtgccaacgccggaaatcctttcggggagaacggcaaaggaaagcaaaatggagggaacacatgagagagaacccatataaacgactgccgcccatagagcgcaggcaggacggttccctttaccgcatgacaccggcacagaggaaacaggcaaacgccctgatctgccgggagtgctgctgttatgaggatgggaactgtatgctccttgatgatggggacacccacacctgcccccagactatttctttctcggtctgctgtaagtggttccgctggtcggtcttgccgcaaatcggaacgctggaagcggagattttccgggataaggagctaaaacgctgtgcggtctgcggcggtgtgttcgtccctaaatccaaccgggcaaaatactgtcccggctgtgccgccagagttcacaggcggcagaaaacagaaagtgaacggaaaaggaggtcttgtgtggacagttaggggctgaaaagtccttgatttacaaggctttgcaagcacagaacagggacaggcaatagaaactaccgtctgccccagaaaacggggttctaaccgtccacaaaacacgatatgacaaacaccatttatatccatcagccggaaaaggcggtcagctttacccggcttcccaattttctttttgaagcccccacattcacgccactgtccaacgaagcaaaggtattgtatgcctttatcctacgccggacagacctgtcccggaaaaacggctgggcggacgaatatgggcgcatttacctctactatcccatcaatgaggtagtggagctgctccactgcgggcggcagaaagcggtcaacaccctgcgggagctgcaatatgccggactggtggagatccagaagcagggctgtggaaaacccaaccgcatttacccaaaatcctacgaagcggttccaaacaccgacttcaagaaatcccgttccggtacgccggaggactgaaaaccgcactccacaagtacgataatcaatcctcttgaagtacggaaaccggacggtatatagaaatacagagataaaaagattgatttatattctatccattccctttctatccgagatattttctgcgggattttcctgtggaaaagtcccggaaaggaatggaatggggaaaggagtttcatggcacaacacgcaattttgcgatttgaaaaacacaagggcaatccggcaagaccgctggaagcccatcacgaacggcaaaaggaacagtacgccagcaatcccgacattgacaccagccggagcaagtacaatttccatatcgtcaagccggagagccgctattaccatttcattcagagccgcattgaacaagccggatgccgcacccgcaaggatagcacacgctttgtcgatacgctgataaccgccagcccggagtttttcaagaagaagtccccaaaggaaatacaggaatttttccagagggcggctgatttcttaatcaggcgggtagggaaagaaaatatcgtgtcggcggtggtacacatggacgagaaaacgccccacctgcatttggtctttgtcccgctgacagaggacaaccgcctgtgtgcaaaggagattattgggaacagagccaacctcacaaaatggcaggacgattttcacgcctatatggtggagaaatatcccgacttggagcgtggggagagtgccagcaagacaggcaggaagcatatccccactcggctgttcaagcaggcggtcaatctatccaaacaggcaagagccattgaagccacgctggacggcattaacccgctgaatgccggaaagaaaaaagaggaagccatctccctgctgaaaaagtggtttccgcagatggagaacttctctgggcagctcaaaaaatacaaggtcacgataaacgaccttttggcggaaaatgaacagttggaagccagagccaaagccagcgaaaaaggcaagatgaaagatacgatggaacgggcaaagctggaaagcgagctgcacgacattcagcagctggtagaccgcatcccaccggaggtgctggcagaactgaaacgccaacagcggcacacaagggaacggtgattgatgacagaaaacatttcacgccgcagcatggcggcaccgcactttgaaaactaaatacggaggtactatggagcatatcagatacaagaaagaaaccgaagtcgtgacttttcagggaaaggaaatcacgctggaaaatctctccccggtgttcacgctggagcaggaagcggcaaaacgccgggagctggaacagcagctttatgaggtgttccgcaagtatgccgacaaacggcagagtgaggaagccggggcataaggttttccgaagccatcgttgatttgcggggctgctgacggtataataaaggtgtcagcagctccgtttcttttttaagaaaaggagcgacaatatgaacaatcgaatagacgcaatctatgcaagacaatcggtagacaaaaaggacagcatttccattgaaagccagattgaattttgcaaatacgaattgaaaggcgggaactgcaaagagtacaaggacaaagggtattccgggaaaaatacggagcgtccacaattccaacagcttatgcgggatattgaaagcggccttgtgcggaaagtggtggtttacaagctcgaccgcatcagccgttccattctcgactttgcgaagatgatggacttcttccaaaagtacgaagtggagtttgtgtcctctacggagaagtttgacacctccaccccgatggggcgggcgatgctgaatatctgtatcgtgttcgcccagcttgagagggaaaccatacagaagcgggtaacggacgcttactattcccgtagccagcgaggtttcaagatgggtgggaaaaccccttacggcttccatacagagccgattaagatggacggtatcaacacaaagaagctggtggtaaatccagatgaagcggcaaatatccggctgatgtttgagatgtacgcccagcccacaacctcctacggggacattacccggtactttgccgaacaggggattttattcaacggtaaagaactgatacgccccacgctggcgcagatgttacgcaatcctgtctatgtgcaggcagaccttgatgtgtacgagtttttcaaaagtcaaggggcagtcctggtcaatgacgctgccgattttacgggcatgaacggctgctatctgtatcaagggcgggatgtgaagcccagcaaaaagaacgacttgaaagaccaaatgctggtactggctccccatgagggcattgttccctccgacatctggctgacctgccgtaagaagctgatgaacaacatgaaaatccagtctgcccggaaagccacccacacatggctggcgggaaaaatcaagtgcgggaactgcgggtatgcccttatgagtatcttcaatccctccggcaagcaataccttcgctgtacgaaacggctggataacaagagttgtccggggtgcgggaaaatcattacttcggaactggaagcggttgtttatcagcagatggtaaagaaactggcaagctacaagacactgacaggcagaaagaaagcggcaaaggcaaaccctaaaattgccgccctgcaagtggagcttgcccatgtggacagcgagattgaaaagctggtggacagtctgacgggtgcaaacaatgtcctgctctcctatgtgaatgtgaagatagcggaactggacggatgcaagcaggaacttctggcgaggatagcggagctgacggtggaagccatcagcccggaacaggtcagccagatttccggctacctcgacacttgggagaatgtatcctttgacgacaagcggcgggtggtggacttgatgattaccaccatagccgctacaagcgacagcttgaacatcacatggaaaatctgacgggcggaacccctcccgtcagaccgttaccctgtgtagtcccttgtaaactgtactttctcattgaccaaatataaattgataacaaagcaattaggaaaactgtagctaaagcaccttattccttttcatctgcctgttttggcattccacatccacatataaaccgagcagtgtataatacacaacaaataaagaaataggcaaagaaaaattaggatttatctccatcaatgttccaacagacggtagaacaacatcgaagacaaataccctctcccagatatttttgagtgccaacgtcttatctgaagccacatgaatcatcagagaaaaaaaactacaaacacgaacatagtcgtcaacacagcacccaacatatggcgaatatatgcaaaaaaacaatctaaatatttaacataacaaatatattttgattatcagccagtgtactatagacatatggtaaaataatcattaccattgcaaatatccgcatataaatcaaatcttacattattctcattgcttttcatatacatcctcttccaatcgaaaatccgacatctactacacatttacattttatcatgaactctttccatatttctgtttcaaaaacttagctgctaagaatgctttaattttgaatatccagtttacctgctccatataaggcagttcctttatctcatccttctttacaatactgtcttcaactttcttttccaaccatacatcaaataaaatttcgcttattctgccacaaaacctactatcaaaatccgataacgtatttgcatcaatactgccagcaacttgaaacagtatattgaataaccatgaacagtagtcgtccatcaattcgtttttcataatcatcatgttaaacatatatccccatgtacgcttcataacagtatcaaatgcatgaagatattcaggacaatccttttgaataatatctctcactattctaaaatgacttccatcatgtgtatgtgcataatgagaatcaagcgattcaatatagtaatgacgttttttaggtgtaaaaaccttgtacttttttaacaatggcctaagctcttcaaatgttattgcagaaccaactatatccttcttgttaggatgcttacctacaaagtgacgtctataatgcactagccctttatattcagaatctacattcttccatatccaatataatcctgtttgtgtaccaaaacgataatttaaggaagaaatattttgtccactatcatctttaacataatcaaaatctagaggatttccatcattatcgagttttgctgctgcgcccacatgcaaaggaatatacattttgtcctctggcatttgatatttcttgtgggttgctacaactattttaactttctctttcaaagcaaagtcctcgcattccattctttatcattaacatttaattctactgacactctttagtccctctggaaaatatcacgtgtataaaccttgtccttcacatcatcaaggacactgtcatacctatttgcaataatcacttgactcagttctttgaacttctctaaattattaacgaccttgctgccaaaaaaagttgaatcatcttctaaagtcggctcgtaaataatcacggctactccctttgccttgatacgtttcataaccccctggatagaactctggcggaagttatctgagttgatcttcatagtcaatctatacacaccaacaacacatttcttttcctcgccaggcgcaaagtctccacgattataatccccataaaatccagctatttcaagtacacgatcagcgatgaaatcttttctcgttctgttactctcaacgatggcagacatcatattctgcggaacatcctcgtaattagcaagcaactgttttgtatcttttgggaggcaataaccaccgtaaccgaaagacggattgttatagtggctgccaattcgagggtcaaggcaaacgccattgatgatctgctgtgtatccagactcttcatttcagcgtaggtgtcaagttcattgaagtaggacacacgtagtgccagatatgtattggcaaagagcttgactgcttctgcctccgtaaatcccataataagggtatcaatatcttctttgattgcaccttcctgcaacaatccagcaaatatgttcgccgattttaccaatcttgcgttttccacatccgtaccgacaataatgcggctcggatagaggttgtcatacaatgctttcgattcccttaagaactcagggctaaagatgatgttttcacagtgatacttctcgcgcacagaggtggtgaagttgacaggtatggtggacttaattaccatcaccgcatccggattatactggatgaccaatttaataaccgcctcaaccgcagatgtgtcaaagtggttcttttcgctatcataattggtcggtgcggcgatgaccacaaaatcagagtcagaataagctgcttctgcgtccagtgtggctgtcaaatccagttttcttgttccggcagcgtcctctgctaaatatttttcaatataatcatcctgaattggagattttctgttattgatcatttcaaccttttcaggcatgatatccacagcaactactttattgtgctgtgcaagcaatgtggcaatagataagcccacatagccggtaccagcgactgcaattttgtaattactcatgattttcttcctctccggcactacgataacgagtacctttttaaacttgatttaatttctcagtggattttgtagccatctataaaccgtcgtaaagaatatacccagtcattcgacttaataatttttctccattacggaaaaccctttcaaaatttagcagactatacttttcgattaatataatctgctgttgcatcagcacaaggcttgataatacaaggatttcccagaacaatagaatgtgatggaacatcgcaattcacatatgtattagaagcaattaaaacatcgtctcctatgacgatatttcctactatcgtcgcgttaattcctatccacacattatttcctattcgtggggtccctttacgtggtcctcgattttcttgacctatagtaacgcctttatgtatattacaattatctccaatgacggcatcatgatttattgtaatgccataagcatgtccaatatataagcctgcaccaattctacagttccacggaatttctatatgtgattttcctgaatagtagctatataacattttataagtcaactgcgctaatcctgttgatttttgactttttctaaataacttttgaaacaggggcataccccccccccccgaatatctggataggtctttttttattatttcatacatcgtcatacctcatttatcaaattgctttctattccagtttaatgttccattgcggctaataatctttgtgagaacatctgcaacagcaacattttcttcgactatatctttatttacaacggcattagcaccaattgctacattattagctatatgtacaccgcctagcacaacagcccctataccaaccgatgcccgcccccgtcctgtattaacaggcatagcgaaattcttgccaacagagactcatccattcatcagaacaggaccagcatgcattattatcaaaccttcttcacaacagttcagttgaatgtgcattgcatacttccactacaacctatataatctcacttcgtaatacttacctaacacctttcgattcgtattgcgataatattcagacttctttaaaaagatataatgcttcgctaaaatatcattctcacgatggggtaacaataccctgcatttttctgtactgctttaattcagtatctaaaaatgattcaaatctttctttgaactaattcgttttccttttggcaacattgtccaattcttcctaaattacgacttaaatataaaattctttataccattctgcgaacttccgcagaccatcgcgcaaactagtgctgggcttgaacccgaaatcacgctccaaaacagtcgtatctgcataggttatcggcacatcacccggctgcatcggaacaagttccttatgtgcctcgaagtcgtaatcctccggcaatacaccagcacgaaccagctcttgctgcagaatatccacaaactccagcaagttctcagggctgttgttgccaatgttgtacaccgcataaggcggcaacggcaaaccatcctcgccagtagcccgatctggcgctttttgcatcacgcgaatcacaccctcaacgatgtcatccacataagtgaaatcacgcttacagtttccgtaattaaagatctgaatcgtcttgccctcacggagtttgttggtaaaaccgaagtacgccatgtccggacgaccggcaggaccgtaaactgtaaagaatcgaagtcccgtagacgggatattgtaaagtttggaataggcatgggccatcagttcattggatttcttagtagcagcatacagggacaccgggttgtccaccttatcgtatatgctgtacggcactttcttgttgctaccatagacggaggaactggaagcatacaccaaatgctccaccggataatttcggcaagcttccaaaatgttaaagaagccaatcaggttggattccacataggcatccgggttggtgatggagtaccgaacaccagcctgggcagcgaggttcacaacaacctgaggtttatactgctcaaacagagaaatgataagccctttatctgcgatgtttcctttgataaaggtaaatgtggaatagctggtaagcttcttcaaacggaaattcttcaaggatacatcatagtaaccattcatattgtcaatgcctatgactttcacactttctacttcatccagcaaccgctgtgccaggtagccgccgataaacccagctgcgcctgtaaccaatattgttttgtttttcaaatccacattgctcatctgtattactcctcgttttaaacacaggcattacctatgtgattatatcgcttacaaccattaaattgctcttatatattcaaaaccgacaatgtcacatttccatacctatcggtttgttcctctaatcttagaaaattctcaaaatattcccctatcgcctacaccagccaagtcttagataccaattcacttgacattccacttcttcaaatccgtcaatttttcatatctgtttttatactacttcactaacatttctctacacaatctcttgactatccgaagttacggagaaacacactcccagttttctctactcgcccctttattacggagaaaaattgttgctgggaatctgcttttgctcatttttcagttctattgaaccaagggtttcttctatataggtgtacaccacaaaaaaatgtttcaaaaattggagcagagttctatgttcatgccaatgctctcgctccaccttttaaaacaatatttgtagagtagacattagatccacagcgtacaccctataatactgtaaaagaagcgttgcaataaataacccaacatatcttgttcccaccaccgcaatcgtgtaatcctttttcttaaagttctcatcttcttgcgaattcgtgctttatccttttttgctgtaagtatcacaacgcgtatccatatatattcataattgtcgtatataaaataaacatcgaattataagtaggtctgccaaaaaagtaatttgttttattacatctctctttaaatatcacgtatctaatgtggactcatcctctcactcttccaccttcaccaccaaatttctgacttctgaccggttcccatccgtatccaccgtatacagcgtcaccgggtattcccccgcttcatccaggtttacatgcccttccagcttcaaattcctataaagcgtattgtagtcatccttatcatccgacatcgcccctatcacttgtccccagtttggcgccgtccccaccttcgtgctcaccacatccccactcatcaccagcaccgggtttgggcccaccggcggttcggttttcccttctggttcctcctgctgtgcctcttcccttctatccggttccacatccgcttcgtccccgtcttcaccgtcctctgcgctaccactttcttcctcactcattgtccctgtttctgtatctgtctccaattccccttcgctactttcctctgtcccgcgaccttcttccaatactccccccataaccgggagcacatccccattcttataagtccctgccaccgggaacgcccgagaggccttccctacattattcgcgctatcccgtgccacatatgtcacgatcacttctttccctgtcgtccccgttaccttttccaccagcaggctgccgctcacatcgccgtcctttgtgtccacagccgttaccccttccagcaacagggcttcgtccataccttcctcatagctaactgaattctccgtgaacgtaatcaccggcgccgtcctgtcttttcccagatacagaaacaaacttatccccaggagtaagatatcgattcccccaattataaatactaacttttttatatccatcttcccttcccccttacttcagttcctctatcggttccgtatcttcaaccagttccaccatatcgatatccaactggatcatgtcctcctccggaaccaggctttcttccgggttcttttctttcaccagttccggaccgtttttattctcatgtgaatgggtgttttcctcccctttcgctgtctttccactcttcagccccttctgtaccacggccgcatgtagcccgccttcttcattgttcccgtaatatttcccataatatttcccataatatttcccataataagcgccataatagcccttcccactcatattcaccttattcaagattactcccaggatccggcaacccacctttttcagctgttccgtcaccttttgggcgaatttgtaactgatggccccgctctctatcacgatgagcgtcccgtcgcagtgctgggcggccaccgcaccatcaataacgctgcctagaggcggcgtgtccacaaccacataatcgtattccttcttcaggtattctaacaggagctggaaggcgtcattccccagcagttcgctggggttcggcggcaccggcccagagaaaatgacgtaaaagttagggatgttggttttgcaggatatgtcggaaatggaagcctgtccgctcagataatgggataatccataccgtgatgcattgcttttatagcgtcccttcaatacagatttacgaagatccgcatccaccaggataacctttttcccgccttccgcaatggatatggcaagttggaaggaaacgctcgtctttccttcattaggagtgctgctggtcacagatatcactcttctgtctttcccggaaaattccaggttggtccgaagggttttataactttctttggtccgaaaatcaagtttttcaatcgcattaaatgtaactgtctgcatgttttttaccttattcctttatctgttgatcctctgtccgtatatttcgcaggtttatcatttttatttccatacatgataacagcagaaaagtaaccgctcccccggtactcttttctgcctcccccaactagcttcttttcacttttttctttttcttctttgcgtccgtttccccttcattcaaaggaatcaccgccagggtggaaagctgcagatatttctccacgtcctccggtgttttcacggtatcgtccatcaggaaacgcaccaggacaatcgcaatcatcaggaaaacaccgagtacgcctccgatcaatgtattcttgagcacactgggaccggccttgtccataggcatatttgcagtttccgacacattcaccgcctggatatccattacgttcatgatatgtaccgccgcggcttccctgatggcattggcgagctgcatcgccatcaccggatccgtatcggtaacggtaatcgccaggattcgggtatccgtgggtgttgttaccgaaacctttttcttcatttcatcataactgagatccagtcccattccctgtaccacttcttccagtacgaaacggctctgaatcagctccgcatagtcctttgtcagctgtgttcccagctggatatcagaataagtcacggaattattttcctgtttattcaaaatataaatcttggtagtggactcatatttgggcacgccaaagatctgggtaacaagaaaagcccccagcgccaccataatacctaccgaaacaattaatgccagattatgtatcaaaaccaggcagatctcccataaatcaatttctatctcatctgtctgccgtatcgtattttcttccatataactgctttctcctgtgtaaatattccatcgcatttttgactgcaatggccgtctgtgttcctgtcatccctgctttacagcagtctgtcttccaatatatagcccggattttccatcagcagctttcccgccgcttctgtaccaagcttcttttccagatatgcagcgcattttttcatccggggcgcacggtttccgtcgctgtgggtgtccgtcgccgcaaaatccaccatttccatttttaaaagcttctttactacgtttttaaccgcaagtccctgatctccggctacgctcgatgcatttacctgaaaataacatccggtatcctccttcagctccgcagccttgtccatatcttttattacattggtataccgttccacatgagccaggatgggccaatatccaaaagaagctgtcctggcaagagcatcccgtatataggagtagtcttcacccggcaggaattctatcagtatgtaatgtgaatctgccatggttcttatttttccggcttcgagtaactctgcaaggccgtggcggtaaaaaatttcgtttcccggatagagcttaacaggaatttttaacttctccgcttcttcctgcagaatttgcagccttttcgttatcccatcaggtgttacacacctgcgatccgccttttgatgaggggtggcaatcatagccgaaatcccctcagatgccgcaatttccagcattctcagcgattgctccatagagccggccccgtcatccacaaacggaattatgtgcgaatgtatatcgataatttcattcatacttgtaactgtttttgtaatttgctttttccctttcgtattattttcttcttgattcaggaaatttacatatgtacgtttaaaactattatattatatacgttttaaacaggtgttgtcaaaccccattttccaaaataattcctttacgggtattttttttgttaatatgccagatatttcgaggttttgttactgtagcaatatttatttttttttgctataataaagaaattattgtcatatttgcatatttatggatgcatacggtgactttcgttaaacatcagccacaaaaaggtaccccgtaacttagaacctgtatactgtcaggaggaacatgcaatgtctgatacctacaatagacttgcggcaggcgaacggctacgtttaaaacgtaccttactggggatgacacaggaagaaatggcggaacggattggccgtgtgccaaaatactatgccgatattgaacgaggcagctgcggaatgtcagtagagacattaatggccctatcccattcattgaacatgtccctggattatattattttcggtaatgagtccgataataatgtccagaagcatcaggatgaaataagtgccattcttgatatactcgatacttgcccggacaaaaaaagagattatgcactcaggctgctgaagctttttattgcagcgtgtaataattaatctcaaaaaaaaattatctgaatttttagtgtttagttttaccccgacatactacttattgatagtaaacaagtatttcagtcatcttagtaaggaaatcacgtaagtctaaaagtctgtaaaaggcagagcagttttctgctctgcctgtcatcaaccaaaattatttccataataaataaaaaaaacacagcctcctttacagaaagactgtgttctatcatcacttattctaaactttaaaaacttcaaaaccgcattatttaatgagcattgcatctccaaaggaaaaaaagcggtacttctccttaaccgcctcttcataagccgccagcacgtgttctctgcccgcgagcgcggataccagcatcaccagagtggattccggcagatggaaattggttatgagcgcatccagcaccttaaacctgtaaccgggataaatgaaaatttcagtattgtcacagcactcttccatgtgtccgttttcatcacaggcgctttctacggtcctgcagctggtagttcccacacagactactctgtgtccattctctttggctttatttatcttgtccgctgcctcccgggttacctgataatactcggagtgcatatggtgttccttaaggttatccactttcaccgggcggaaggtcccaaggcctacatgaagggtcacataggctatatccacgcccttctgttccagctcctgcagaagctctgtggtaaaatgaagccctgccgtaggcgcagccgccgatccttcatacttggcatataccgtctggtaacggttcttatcctggagcttatgggtaatataaggcggcagaggcatttctcccagctgatccagcacttcctcccagataccctggtattgaaactgaatcaggcggtttccttcctccacaacctccagtacccgggcatgaagcagtccgttgccgaataccagctttgtaccgggccttgcttttttacccggttttaccagcgtttcccatatatcattttccctgcgcttcagcagcagcacctccacggcgccgccggtttcttccctgattcccatcagcctggcaggtattaccttggtattattcagcacaaggcagtctccgggttccagataattcccgatttcccggaacacatgatgagaaacctcaccggtctctttgtccagaaccatgagcctggaggacgaacggtcctccagggggtcctgggcaatcagctcaggaggtaagtcataataaaaatcagatgtttttaattcttccatattccttcttcttttccgaagtatggctgcttacaggccggcctttttcaggaaagcaacataacctctcttcgtttcatagacgtcggccttgctggtggcttcccagggtgcatgcatgttaagtacggctacgccgcagtcaatcacgttcataccatataatgccatgatataagcgatggttccgccgccgcccacatcaaccttgcccagctccgccgtctggaataccacatccgagctgtccataatttctctgatatgtgccatatattccgcattggcatcattagaacctgattttcctctgacaccggtaaatttgttgaagaccatgccgtttcccatgaacgcagaatttttcttttcaaagcaggaggcataggaaggatcatagcctgcgctcacatcagaggaaagcatagtggaattggacagacatcttcttaaattcagttcactgtattctcccataagctccatcagttccgcagtcatattttcaaagaaacgggactgcataccggtagctcccacacttccaatttcttccttatccacaaggatacagcatgccgtacggtctgttacctctccggccacttccagaacagccctcgcagaggtatacgcgcatactctgtcatcctgtccgtatgcaaggatcatgcttctgtcaaagcctgcttccctcgctttgcctgccggaacgatttccagctctgcagaaaggaaatcctgttcctcaataccataggactccttcagaatattcaatacgcctgccgtcactgcgtctttatccttgtccttcacaggtatgttgccgacaatcagatcaagagcctctccctcaatcactttagccgctttcttttccatctgttctccggccagatggaccagcaggtctgaaatgaagaaaacaggatcatcttcattgtcacccacattaatctccaccgtggtaccatccttcttaactaccacaccatgcagggaaaggggaatcgccacccactggtatttctttaccccgccgtaataatgggtatccagataagcaatgctgctgtcctcataaacaggattctgcttaacatccagcctgggcgaatcaatatgggctcccagaatattcatgccttccttcatgggctttttcccaatctggtacataaccagacatttgttcatattgacggcataaatcttatcccctggcttaattttgcttccgctttccagtaaagcgttcagttctacgtagccttccttttcaatcaggttaacaagggtgtccacacactctctttctgtctttcctgcatccagaaaatccatatattctctggcaaaggcttccgcttccttcagctgttcctctgaatagctgttccaaacatttttcttttccatcagtcgttacctccggttccctttatttttgagccaagcaccggtgcgagcagctgtttggcttttgggacctcatcactgtggatacggaagatgcaggcagattttccccttggtttccgaaaaaagagcaggctgttcagccccttctcttcccactccacaaaataggagatcctgttttttaaaaggatccgctcgaccttttcttttgtttccatatcatacactttacaaaaatccacttcgtgatttaccgttccaatatccatatctgctcccatctgcgtgccatgcacgcatacgattaaaatcgtacttaaatcagggaggctgcatacggcagaagccgtatgttaaaacctcgcctcttttaaaaggtgcttcacaaatcttattgtactactgtctcagctcaatgccaagaccctgaagtccattgaggatttttttcattgccgcactgacatcggcatcctccagcgtcctgtctttggcacggaaggtgagcgtataagccaccgatttgaagcctgcctgaatctggcttccctcatatatatcgaacagggagtagctttccagaatctttccgcctctctgggcaatgaccgcttctatctggcctacaagtatttctctggggactaccatgctgatatcccttataaccgcaggatatttggcaattccttcgtattttctgtcaaatgtggcgaacggaatgatttccggcatatccagcacagccacatatgctttggtgccgatgtcataattatccagcacttctggatgaacctcgcccagataaccgatcacttttccgccataggaaatgtttgcctgacggccgggatgaaggaatttctttcctgcattggggtcatattcttttttcccgttcattccgatgctttccaggaattcttcgataatgcccttcatggtgtagaaatcaccgtctccatagaatcccagtgtaaactgcatccgctcttccggaagctctgttaccggcacgctgtgaggcagataaacattgcccagctcatacagcttaacggccttgtttcttctattataattggttcccagagaggtgaggatgccgttcagggaaatcgtcctcatgatggaaaaatcctcacccagagggttcgctatcgtaactgcttcacgaagtttatcctctttatccagcagcagcctgtcaaataccttcgggctttcgaaggaataacacataccctgtgaaaaaccacagtattccgcgatatcccttgctttttcttctatccggagcttgaaggaaagctttcctgtagtagcttctccgttaggaagggttgtggggattttatcatagccgtaaaatcttgccacttcctccgccacatctgcgaagccttcaatatcctgacggaaggaagggataatcagctctttctttgcttcgtcatattcaaattccagacgtccgaaataatccagcatttccgcttcgggaatctgagtacccagcagtgcattgatacgttccggctcaaaaggaatgcgtactctttccttcagaggcgcgcatacatccacgattcctccaaccacttcaccgcagcccagttcctgaatcagctgacatgctctgttaatggcatccaccgaattattgggatccaggcctttctcaaatttgccggaagcatcggtacgaaggccgatacgcttcgcggatttgcggatgttggtgccgttgaagcaggcagcttcaaacaggactgttttcacgtcatctgtgattttggaattctcaccgcccataataccggcaatgccgacttccttctcggcatcacagatcattaatacttcgctgtccagctttcttacctgtccgtccagtgtctggaattcatccccatcctttgcacggcgtacgatgatctgtctgccggcaatggtatccaggtcgtaggcatgcatgggctgtccatattcttccatgacatagttggtgatatcaaccaggttattaataggacggattccgctcgctgccagcctcctctgcatccacttgggagaaggggcaattttgatattggtgcatacccttgcacaataacggggacataaatccgggtcctttacatccacctttatataatcattaacattttccgcattttcatgcacttccactacaggagggacaaaaggcttacggaaggtaaccgcagcttctcttgcaatgcccaggatactgaagcaatcaatcctgttgttggtaatctcatattcaaacaccgtatcacgcaggcccagagcatcaatagcatccgtccccactacagcatcctcatcaaaaatatagataccgttttccggcgcttccggatacatttcccggctggagcccagttcttcgatggaacacatcattccgcaggaaggcactcctctcaattttccggccttgatagtgattccatcctccggaagcgggccgccgtcatgtccgcctgcaacctttccgccgtcaagcactaccggtaccttatccccttccttaacattgggggctccggtaacgatctgaacggtttccgttcccacatttacctgacatacaatcagcttatccgcatccggatgcttttcaattttttctatctggcccacaacaatcttttccagattcttatccagggcttcgaagctttccaccttggtcccgctcattgtcattgcatcgcagtattcctgatccgtgcaggaaagctccggcacatatgcttttatccatgatatcgttgtattcataatcccaaaccagcctttcttatttctaaatctcgactcttatttttatcagaactgcttcaggaaacgaatatcgttttcatacagcaggcgcatatcatctatctcatatttcagaagagcgattctctccaggccgacaccgaatgcaaagccggagtattccttgggatctatgccgctcatctcaagcacacggggatgtaccataccgcagcccaggatttcaatccagcctgatcccttacagaaacggcagccctttcctccgcatttgaagcagctcacatccacttccgcgctgggctctgtgaacgggaaatgatgggggcggaatttcacctttgtttcttccccgaaaagttcttttgcgaactcagccagtgttcccttcagatcggcgaaggtaatgtttttatcaataacaaggccttctatctgatggaaggaaggggaatgggtggcatccacttcatcggaacggaatacacgtccaggcgcaagcatacggataggcagctttcctttttccatctcccgcacctgaaccggtgaggtttgggtacgcagcacgatatcctctgaaatataaaaggtatcctgctcatccctggtaggatggttcttgggaatatttaatgcctcgaaattgtagtaatcattctcaacctcagggccttccaccacttcgtagcccataccgataaaaatacgttccacctcttccaacgctatggtattaggatgacggtggcccaccagatttttcttagccgggagggtaacgtcgataacctcctccttcattttagcctctctgatggcgccttccattttctttttggtcacttccagcatggcttcgatttctgctcttgtatcattaaccatctggccgattttagggcgttcttctgccgccacatttttcatgcccttcagcacttccgtaagggcgcctttctttccaagggcattcaccctgacctcattgagcttatcaagggttcctgcggcctccacctgtttcctgacctcttccttgatttgttccaatctgtccttcataacaaactccttcctgttctgaaccgcagtgcggctgataaactttggggattcgtactcttttgcggatttacagacacaaaaaaatccccagcataaatactagggacgaaataataatggaagtctctcttccatttccgcggtaccacccacattcctgcttccgttaccggcttatgccgttctgcttttgcaggctctcttacggcgtaacgtgccatacgttccttcctattataatataccgcagtcagccgatcatatttccataaaacgcatgatctcagttaaccttcagcagcatattactgataaacccttcagaaggacagctccggcgtgaaaatcaagctgcatttgaacccggggaagcttccagccggtgacttcctctctctgttggaaaatacatctctttatgcgccatctttgcctttatatttataaaatatatctgttacctattctattgcctgttttcggaaaagtcaataattttttatgtacttttaatttctatcgtgatatgattttaatgtgtctgcacatttatcggactatcactatacaagaggagaaaaacatgggtggattttttggagtagcatcaaaagaggattgtgtatttgatcttttctttggaacggattaccattctcatttgggaacaagacgggccggtttggctgtctatgaaaagggacgtgggtttgaccgttccatccacaatattgaaaatgcacctttccgtaccaaatttgacaaagaggtcacggaaatgaaaggaaacctggggatcggcagcatttccgactacgagcctcagccgttaatcgtacgttcccatcacggaacttattccatcgccacagtgggcaaaataaacaataccgaggagatcctgtccaatcttcttgcatcttcccacattcattttctggaaatgagcggaggcagcatcaacgccaccgagcttgttgccaccattatcaatcaaaaggaaaatataatcgaagggattcaatacgcccaggatctgatcgagggttccatgaccattctcatcatgacccctaaaggcatctatgctgcaagggacaggatgggccgtacccctgtcgctatcggcaaaaaggacgacgcttactgtatatccttcgaaagctttgcttaccttaatctcggttatatcaatgaaagggaattaggtcccggggaaatcgtaatcgtaacgccggaaggcgtacaaacgctggcggctcccgggaaagatatgaaaatatgtaccttcctgtgggtttattacggctatccctcttcttcctacgaaggaatcagcgtggaaaaaatgcgctacaactgcggtgcgtccatggcgaagagggacgatgcttccccggatatcgtggcaggcgttcctgattccggcacagctcatgccattggatattccaatacctcagggattccgttttcccgcccttttattaaatatacgcctacatggccccgttcctttatgcccactatccaaagccagcggaatctgatcgccaaaatgaagcttatccctgtccgtgatctgattcagggccgcagcatgctgctgattgatgattccatcgtgcgcggtacccagcttagggaaaccacagaattcctttatcaaagcggcgctcgtgaagtacatatccgtcccgcctgccctccgctgctctacggctgtaaatacctgaatttttcacgttccacctcggaaatggatttgattacccgacgggttatacagcaaatggaaggcgatcgcaaatatattaacctggatgcttattccaatccggaaacaccggaattccaggccatggtatcccaaataagccagcagcttaattttacatccctgcgctataaccgtctggatgatatgattgattctgtaggaattgatcgctgcaagctttgtacctactgctgggacggaaaagaataaagaaaaaaagaaagcatttaaaaaccccaacagcggattaaactgttggggtttttcattatcattttatcctcgaatatcaaggtattcttcttagttagagaacatataagcggtacaaagcttaacaccggaaccggtattggctacatatgtataaataccaatctttgtgtagttgccgcttaccatgttgctgtagtgtgaaggacttgccttcaggcttgcgaatacgctgtctgctgcgttgttctgctcggaatctgaaaatccgaagcttccgtatgtaatataggaaaggttttctccacgccatttggttgagctaatcatatctgctccacttgttccgttaggacgggtgtggctccaaactgtattgatttcttcgcttcttactgctgcatagctgtttaattcactgtcaagggtcagtgcgggaagtccctgctctgctcttaagttgttgatgtctgccagaagtcttgcattcatggtagaagtctggtctgctgctgcctttgcatccatctttgctgcgggtgccattgctgttacgatgattgttaatactgctaatacggtgatgattgctttcttcattttccttcatcctttcaaatcgtgtcgattgaaaaatgatggaaaactactcaggcttttcagttatttaaaagtagtgacagtcttatgactatcgatacagtaccgtgtggtaccggcagctggctgccatcctttttaaggggaaggccctgtagctttgcgtccttacttttcaataagtttgccgaatgtagttttcacgcctttttcaagttcaaaggcctgacaagtaaaaaaaatagtcttgtgtcataaggcgaccaaggctactttgcaaatacatacgtttttactatgtatcaggcaactggctgccatcctctttgagggaaggccctgtagctttgcgtccttgcttttcagcaagtttgccaagtattaaattaaataatatgatgattagtgatgtatgatgatttctttgatagttatataatacacgacatctatgaaaaaatcaagtactttttcctattttttcatatattgtaactattttcataacaccctggacgaatttacgtatttactgtgcagtttatacgaatattcagcgaaaacaggcctcagatccgttcctgcgcgccggacctgagaccgaagcagttcagaaagctgaactgtgagctgttttaggaaagcagttcttccaccgcatgatccaaaacctggaagtaatcttcgaatgttttgcggcagcagcccggatccttgattatgatgccttccgctcttagtccgatgagggaaaagcccatcgccatcctgtgatcctcataggtttccacacatcccggagccggcttccccggccggataagaatactgtcctcctctgtcatgcatgatattcccagtctgccaagttccgcggcaatcgcccccatccggtcactttcctgataacggatatgtcctatcccggttatttttaccggagcatccgcaaaaggggctatggccgcaagggtaatcgcctgatccgaacaggcgtgcatatccgcttctacaccacgtatccgtccattttccggccccttcagccaaatgccctcttccctttcctgaagccggcatcccattttttccaaaatacgcaggaactgtacatctccctgcagggaagcgaaatgtactccgggcactaaaacttccgttcccagaacggccgccatcgcataaaagtaacaggccgccgagacatccggctcaatggcataatcctgatgccggtaaacctgtcccgtactgatatggaaacaatcggttccctttctttgtacaaatactccgaactgctccatcatgcgcagagtcatatcaatataagccataccatgtgtcccttttacatgaatatccaggcttctgtccccgcagcaggccgcgatcagcagcgcgctcaggaactggctgctgtgttcgatatccacggaaatctcctgcgttccattttcccccggatacagggtaaaagggaaatggccttccttttccccatactccacccgggttcccagctcctgaagtgactgcagcaggggcagcatgggcctgcgcttcatctgctctgaggaatccagatgccagacgcccgtcttcagccccagcagcgccgtcaggaaacgggctgccgtacccgcacttcccacataaacagaagcttccttcaccggcagcctgcctccgagtccccctacccggataagggctttctcttcctccgcttttatatcgattcccaaatctgcgatgcactgctgcagataacgggaatcatcactgaataaggctcccgtcagagtacaggggccatccgccagcatggacagaagaagcgccctgttcgtaatgcttttagagccgggaacccggaccttaattttcctgtcctgtcctgttttcccataaatatatggtacataataactgctgctttccattatatacgtcctccatatgcctgttcacagacaatcattccttgaatttcacccaataacatgttacgatactatctgttacgagtcaaatcttatatcgtaaaattaaatcgaacgaggaaaaacaaatgataaaagatctctttgccgaaaaaaagcaattactttcctttgaggtttttccgcccaaaaaggaagacgaattcgccaatgcctttgccgtgctggattcccttgccgtccttcagcctgatttcatcagtgttacctacggcgccggcggcagtaaatctaaaaaaaccgtggaaattgcctcctatatacaaaaccagcttcatatcatggcactggctcacatgacctgcgtgggctccaaaaaagaagatatcgatgcggtaaccgcccagctgaaagaagttcatgtaaatcatgtgctggcccttcggggagacaggccttcttatatgagcgatgagcagtttgacagccgtcatttttcccatgctgcagatttgattacctatctgaaaggggaaacagatctgcatatcgccggggcctgctatccggagaagcattatgaagccgccgatttggaaagtgatcttcttcatttaaaggaaaagtgtgatgcaggcgccgagttcctgatcacgcagctgttttttgataatgaagctttctacaaattcctggaaaaaagcagggatgccggaatcacgcttcccgtctgcgccggaatcatgcccattacttccgccaaacagctgggaaccacggtttccctgtccggctcagccgttcccaaacagctggcggatatcattgccacctatggtgatgatcctgcggatatgagaaaggccggcattgattatgccatccgtcagattttggatctgaaagcgcatcatgcggatggtatccacatttatacaatgaataagcctaaggtggcacaggaaatcgtatcagccatccaataaaccaacctcaggcataagaaccctgctctacaggccatccttatgttccatataaaaaatcccctcctttcctgctcgaaaggacggggattttttatatatacttttctgatggatttccaatcattccagaataaattctgcctgcatctcacagccgctgtgaggagcaaccatcacctggaacttgcctgtctccgaacgatattccatatcttttccataaaaacgcagcatgtcttccgtaataacaaattccacagtctttgtttcccctgcctccagaggaaccagctgtacgcctttcagctccttcaccggacgcaccacactgccggccacgtcgcggatatacagctgcactgcttccacgcccgccatatcaccagtattggtaacatccgcttttacggtcagagggctttccctgtgcataatatggctgctcaaagtcaccgggctgtattccgccctgtgataagaaagaccatatccataaggatataatggctcgttatcacaatctgtataacgggagaaaaagcggttcggcgttgtcccgtcatagggtcttcccgtccggaaatgattatagtacaaaggcatctgtcccaccctgcggggcatactcatggacagccttccggaaggattctcttttccgaacagaacatcggcaatcgcatgccctccttcggtccccggaaaccaaacttcaagcagggcatccgataacctgccaacctcatccagaacaagcggacgtccgccgaacagcacaacaaccactttcgccgccttttcccggactctgcggagaagctcaagctgatcgccgggcaaatccaggcaggtacggcttccgccctctccaccctgcaccacggcttctcccagggccaatactgctacatcggcctgctgcgcaagcttttcggccctttccatttcctgctgacgtttttctgtactccatgcttccattcccatctgttccattataaacggaaggtcacggtaatccttttccagcaaggtttcacagccgggggcgctcgtcacgttttcttttcccgccgcttcttccaatgccatttttaaggtaactacattctctttgtttccatgaatggcccacatacccagggcatcctggttatccgcataaggccctatgacagcaatcctgcagccattttttaatggaagggttttctcctgagcataagtgtcatccgcggagcgcggcatcccttgtttattttccagcagaactatggttttcactgccgcttctctggccagcctgcggttttcttcacagaggaaaagacgggcttcttccgcttcatcggctccgcggtaaggatcttcaaataatcccagcttattcttcagcctgaggatacgcattaccgccttatccagcatgccttcatcaattttgccttccttcaggagtccctccaggtaattggcataacagccggtacacatgtcaatatccacaccggcttccatagccaggcgggccgcatccttctgatcctctgccgctccgtgaagcaccagctcagctattgctgcataatcggtgattaccacgccgtcaaagccccactcctcccggagaacatcattcatcagccacttatttcctgtcgaagggattccgtccacggtattaaaggaagtcatgatcatttcacagcctgcatccacaccggctttataggaaggaaggtattcctggcgcagcctgcgctcagacatgtccaccgtgttataatctctgccgccctccggcgcgccataggcggcaaaatgcttcacacaggaggccatgcccgccggcttcgcttctccaaggcccttctggaagccttttaccatagccgcggcataaaggctgttcatataaggatcttctcctgtggattccaggcaccgtccccatctcgcgtcccttaccagatccaccatgggcgaaaaggtcacatgggctcctgccgccacactttcttccgaggtcgcctcacacagcctttccagaagctgcggatcgaaggagcatcccagggccagcggaataggaaataccgttcggaaaccataaataatgtccgccatgaacagcaggggaattttatgtctgctccgttccagataggccttctgtaccgccctgacccgctgcgctcccaccacattaagggtggagcccacattacgggccagttcttcactgagccccaaatcctccctgacacccagttcctgtccctccgcattcagcacctcgccaggcacctgcaccagctgtccgattttttccgtcaaagataaggaatccaacaattcctgaagcttattctcctgcatttcttatcattccctccctaaaccagagtgaaagccatattctgttttcacgcccacatggtatcgtccgaaatttctatttttttatcccgcagcatcagatcgctcacagcctgtgccgcaggcttcccgtggaacagcacttcattgacctgctcaataataggaagctgtacctgatatttttctgcaagagccatggccgctttggcggaataaacgccctccaccaccatcttcacttctttcatggcctcttccatcgtacagccctgcccgataaggattccggccctgcggtttctggaatgcatgctggcgcaggtaacgatcaaatccccgattccggataagccgcagaaggtttcaaaatggcctcccatctggattcccaggcgggcgatttccgtaattccgcgggtaataagcgccgccttcgtattatctccgtagcccagaccatcggcgattcctgccgcaagcgccaccacatttttcagcgccgcgccgatttcaattcccagtacatcagggcttgcatatacacggaacacttcattcataaaaatattctgaatatattccgctgttttcttattccttgcccccgcgacaatgacggtgggcagccccttgcctacttcttccgcgtgggaagggccggaaagtacggcgacctcagcctggggcacttcttcttcaatgatctgggaaagcgtcatcagggagttttcttcgattcctttggcaacattgacaataatctgccctttgtccacaacgcttttcagctgagccgccgtgcttcttgtaaagggcgaaggtactgcgagcaccagcagatcctttccttccaccgcagcctttaaatctgtggtaaaaacagtatcctccgaaaggattacgccgggaagcttatccttctgctcccttttctcccgcagcatctcaatttccgcctcaagtgcggaccataccgtcacatgatgcccgttatttgtaagaagccaggtgagcgctgttccccagctgcccgctcctatcattcctatttcagccattattgatcccttccgcctgtcgccagactctgctttttatctttcattctttcactgcttctttattctttttgaacagataggtttttctctcatttccatgaagcagccgtttgatattttccctgtgcttccaatacgccataacggtgagaaatgcgccgattatgtaaagctcaatgagagccgcctggctcattccgaaaatacccatctggcctaatactaccagttcaatcatgaatcccgcataaacgagaagggagcccagagatacataatgagtggtaaggaacgctccgaagaacaaaaccacgcctaccggtataaaataaggatggaaggaaaggataagaccggctgttgccgcaattccctttcctcctttgaaattaagataaaaaggaaaattgtggcccaggattgcacctgctcccgcatacagcatatacagatatttcatatccggatggctgtttccaaacagaagccttacaacaagcaccgccaggatacacttaataacatcccctccaaaaacaatcagtcccgccttagtgcccagtacacgaagagcgttcgtggtaccggcatttccgcttccgtaattacggatatcgatgccatgcatctttccataaagaaatgaagtctgaaacaggccaaatacatagcctatcaaaaggcaaactactcgaatcatcttatcttgtctccttccgttccctgataataaatttcaggggggttcctctgaatccaaaggcttcccttattttattttctatataacgagtataggaaaaatgcatcaattccttatcgttcacaaaaataacaaaggtaggcggtttcacggccgcctgggtaatataatagagacggagcctctttcccttatcggacggcggctgctgcatcgccacagcctcggccataatctcattaagcacaccggtagcaatccggagcgcatggttttcaataaccgcatcaatcgtttcaaaaagcttgggcaggcgctgtcctgtcttcgccgatataaaaatgatttccgcataaggcatgaaggccagcgtattcctcaccttctcctgaaaacggtatatggttttatcatctttttcaatggcatcccatttattcaccgctatgatcatgcccttgcctcgttcatgggctattcctgcaatcttggcatcctgttcggtaacgccctcctgggcgtcgattacaagcactaccacatcggcacgctccacagctcccacggtacggacgatcatataccgttccagctcttctttgattttatttttcctgcgcagtcctgccgtatcgataaagatatattcttttccgttatgcaccacctccgtgtctatggcatccctggtagtgccggcaatatcggatacgattacccggttttctccgataagcttattaataatagaagatttcccgacattcggttttccgacgatggcgattctgggcctgtcgtcctcatcctccgcctcggacctgtccgggaaatgcctgatgacctcatccagcagatcgccgatccccatccggttcgccgctgaaataggattgggatctccgatgcccagattataaaattcatagacatccgccatgaacttgtcaaagctgtccaccttattgaccaccagaaccacaggcttatgggaacgccgcagcatatccgccaccttggaatccgaatctacaagcccctgctttacatccaccatgaagaggataacatctgcggtatcaatggctatctgagcctgttcccgcatctgcgacaggataatgtcactgctgtccggctctattccgccggtatctatcagggtaaaggcccgatccagccaggtcacatccgcataaatacgatccctggtaatcccgggagagtcctttacgatggagatcatctctcctgccagagcgttaaaaagggtggattttcccacgttaggtcttcccaccaccgctacaattggttttctagttgtatcactcatatattttttccatccattcttctgataaaagcgttaacaaagtcatatccgcttgattttacaatatctgtcttcacttgtaaagcccctgacaggtcccggaccgtaatatcatccagcaaaacctgttcaccgctccttaatatattttccggtaaatacaggatttcacccaattcctgccccttaagctgcgcgataatatcctgtcctgtgagcagccctgtgaccgtgattttttccccgaaaaaatcattccttacaggataaacatggattgatatctccggaaaccgttccatgatacgatccgccattctgcggatatagggataagcgatctttcctgtgacggaggaatacgtcccttccaggattctgccttccagcgctcccggttcttccagctgacggagggcatcttcgaattcctccagcataagccttatcatacccacgccgttttccagctggagataaccgtcgtaggtttcctccggcggcatttcctctcccgcaaggatgtaccattcgtcgctggcatgtacaaaatgaagcccgtattccgggaaaatcttttcctgccagccgtgaatctgccccagcacatatttagcatcctcccgggtaaacggttccagcggctccagaccctcccggaatttggacaatcccacgggaacaacggaaacgctctgcagatgcggcaggtacctggtcaggtccctgatggagcggtccagctcctctccgtcattaaagcccttgcaaaggacaatctgtccgttcatctgaatacccgcttcataaaaaagctccgcctttttcaaagcttcccctgcaaaccgattatgcagcatccggcaccggagctccggattcgttgtctgaaatgatatattaatgggggacaggtgatatttaataatcctctccacatccctttcggacatattggtaagcgtcacataattaccctgaaggaaggaaagtctggaatcatcatccttaaaatataaggtttcccgcattcccttcggcatttgatcgataaaacagaaaatacatttattgctgcaggagcggtattcatccatcagcccgttttcaaaagtaattcccaaatcctcttcataatccttatctatttccaggagccattcttcaccggagggctttgccaccagtacctccacatattcctcttcaatcatatactggtagtcaaaaacgtcttccaccgtttccccattaatttccagaagcctgtctcccggctcaatccccatttcacaggcaatcccgtcttcactgacagcctggattaaatggccttttcttttcatgtaaactcccatccgtgcaccaggtacacttttgtctttctcgcctgaacggcttttcctttccttattctactagaatttccttgacgtgtcactagcataatgttataaaataaattagctatgtgtttttcaaaataatacttacatagttttgcagcagtaaatgcttcgctgcaaataaagaaaggtctgctgccggcagacagacaggagaaggatatgccaaatgtacgcgaactggaaaatgcacttcctgtagcccctctgaaggttctggccatggaatccgcctcggccatcgggaaacgtgtcaacaattatcttgttgaattccggaaaaatatgaaaaataccaaacatgatgatcctgcttttcggggatacatcgaagacagctacctggtggacgcctccaatccccgcttcggaagcggtgaagggaaaggaattgtccgggagtccgtcagaggaaaggatcttttcataatcgtggatgtatgtaaccatagtctgacctattccatcaacggatatacgaaccacagatccccggatgataattaccaggatctgaagagaatgatttcttctgccgcaggaaaggcccatcggataaatgtggtaatgcccttcctctatgaaggcagacagcataaaagaaccagccgggaatctctggactgcgcttatatgctcaccgagctggccgatatgggtgtcaataatttcataaccttcgatgcccatgatccgagagtgcagaatgccacgccattaaacggctttgacaatttcacccctccctatcagttcatgcgtgccctgcttgatacggaggatgatctgataattgaccaggagcacaccatcgtcatcagccctgatgaaggcgcgctggatcgtgccgtatacttcggcaatgttctcggcgtcaataccggtatgttctataaacgcagggattattccactatcgtaaacggaaagaatcccattgtcgctcatgaattcctgggggacaatattgacggcaaggatgttatcatcatcgatgatatgatctccaccggcgaaagcatgcttgacaccgcccgtcagctgaaagaaatgaatgcaaaacgtgtcttcatctgctgtaccttcggcctgttcaccaacggactggaatcctttgacaaggcgtatgaaaactgctggttcgaccgggtaatcaccacaaatctcacctaccagcctccggagatatacaccaggccttattatacggaagcggatatgagtaaattcctggcttctatcatcgacttcatgaaccatgatgtttccatgtcccacgtaatgacgcctacggaaaaaatcaatgaaatcctggccagatacaataaccgggaagaatatcatatttaacagctgagggaatgcgttcttctcttccctctcatacaaaaacggacaaaggattgtgctttcggcacatctcctttgcccgttttcttttctctgataaacgacggctcagcctttaatcatccatacaggggaaggtcagaatcaccttaaacagatccccgtccagataaatctcaaatttaccgttctgcagttccgtcaggtttctggctatggacaagcccaggccgctgccttccgtacttctggaaacatctccccgtataaaacgctccgtaagctcatccgcgctgatattcagggactgggccgaaatatttttcatggaaaaggctgctgtctttttcccgtctttttccttcacggaaagatccagataaacccgggttccctccagcgcatatttatatacatttccgaacagattctccaccacacgccagatacgcctgctgtccgcttcaatatataccggcttttcaggcatggccgcaaccataatcaggcatttctcattcattttttccgagaattcccccatggtctggttgataagctcaacaaaattaattttttccatctgcagggatatatttccggaggaaattttggaggcctccaccaaatcgtccgtcagctgcttgagcctctgggatttactgtccagcacctggatataccctttgatcttctcgtcctggatatcctctcttttcagcagattgacaaaattgattatggatgtcaggggtgtcttaatatcatgggaaacgttggtgatcagatccgccttcagcttttcatccttcatactggtagccaccgcttcctgtatcccgtcgccgatactgttcactgtttccgcaagaatcttattttccccatgcatcctgctgtcgtctattttaaacccgaaatcgccttcgccgatggtctgtgtcccttccacgattttctgaaggtccttacgttcctgataaagaagcgccgccacacacacatcaataacacccgcagccagaatccccggcacgccaagcattccgaaaaagagattcagggctgttatgaagaaaaacggaatcaaaagccggctcactatatggctgttatcatacaaacggaaaaacagctttcggatgagacgtcccagctgccaaagcagggaatcccgccagaaccggtgcactttgagccggcgtaccagccccagataaaaggatgtggctatccagtcaaacagaaacgccgccaaaaccgcacctgcggtcatcataaacgggcttatgtctccttccagcgcatagctgaaggcaatatcataggctgcggcgcaaagtacgcagaagcctgccgtaacggaaaagcccagtgtcaggaaaatctctgtcgggaaccgatcacccttttttgtctccaccacatagccgtcctcattctccgcttccttcctgccttcataaaccgtaagcacgcccagaagccacagggaaaggatcagcgccagaattcccagcaccgccgtctgccagtaataaggcataaagctgacaaacgtattcctcgcctgagccaggctgtcaaccaccccataggatgtgtccacaccgatccagactctggaattctctgcaaatacatactcgtaggggctcagtatcccccgcatttcctccgtagtcatctgtgtattggtcttgatttccacccgatccggattatagtacagatatcgtccgtatccgctgaattcctccgtaatctcctgttcactctttccgttaaaattctgtggaatattcgtaaaataacgcggctctccgtccaccgtcatctgataacaataccggatgttggtcttatcttccccatagaattttttaaagctgctgtactccgtaaaattatggtacagctggttgcaggctgccaccagattgtcacgcagcaccagatattcatccaaatcagaagcataatcagccaaatcctggccctctgcggaataatagcggggcaccagaatatccagggcaatcacttcatccgtatccacttctatttcccctttttcagacgccctctccagatatccctccaggctgtcgggaagctcggcgatcatacgcatgctgagggaatccgattccgccgcctgggcggaaaatttaatggcctgcttggacagatcctgctgcagtttgaaatccccgacactcagctccccgggaatctccgtatcacttttccccaggccgaaataaatggaaaaatcattttccgtaccatagacggtttcataattgaaaccataattcccccatttaatcaaatcatccagataatattccgccgtcacctccgattcggaaagcatgctggttctgtttacataagcggtgatgtctatcttctttttcccttcatattccccgttggtttccaactggctcttgataacggacatccgggtaatgtcctggacatcattccggaggatatcatcaaaaatttccgaatcctcgaacaattccttttgagaaaagggagatatgaaataacggctttttccgtttgtcccctccacagttatgaatgaattggatataatggcgatcacacagcctgccgctgccgccgtcaatattcttttggtaaacagaagaaatatccgctttcctctcccgcaaacattcgacttcttcataactttcctcccggagctgtcatttttcctgcttccttttgtgctgttccgtctttactgcttttcaatcttatatcccactccccacactaccttcagatatctgggttctttggggtttatctctattttttcccggatatgacggatatggactgccaccgtattatctgcgccgatagcttcctcttcccaaatactttcgtaaatctggtcgatagaaaaaaccctgccctggttttttaccagaagcagcaggatattgtattcaatgggagtgagcttgaccggttcatcatccacggtcacttccttcgtctcgtcattgatcacaaggcctcccgcacggaaaatcgcgttgttttccgaattcaggttgcccagctgggtatatctgcgcagatgggatttcacccttgccaccagctccagaggattaaagggcttggtcacatagtcatccgccccgatgttcagcccgaggatcttatccgcatcctccgatttggccgacaatataatgatgggaatgctgctgtattccctgattttcagtgtggcatgtatcccgtccagcctcggcatcatgacatcgataatgagcagatggacttcattggtcttaagcgcccggatcgcctgctccccgtcataagccttaatcacatgatagccctcctgcgcaagataaatctctatcgcttccactatctctttatcgtcatcgcataccagaatattcgtcatcttcagtcgctccttccgcaaagcttttccgcagcattcctgcgattttaagcacgctttgcctttttgcatcagtataccacataatgaaccagggtaactattattttattaaatcatgaaagatttaatttccaatgggattattgttaagtttttcttaaaaatttttatcatctgagcgcatgtttcttgcatttactgccattctcccttaccatataagatacggccgcttatgcagcagcctgacagtaaagaggaaaggaattcatacccatgcaaaactgctttcagtccacaggaacctatatagcggatcaaagcctgacagacagcgtcaatatagctgccgccctggaaaggccgctgctcattaaaggagaacccggcaccggaaaaaccatgctcgcccaggctgtagcggaagctctgggcatggagctgattacctggaatatcaaatccaccaccaaagcccaggacggcctgtacacctatgacaccattaaaagactctatgacagtcagttcggggaaaagggtgtgaacgacatttcccgctacatccggctcggccggctgggagaggcttttacccgggacagccggaccgttctgctcattgatgaaatcgataaagcggatctggaattccccaacgacctgctttgggaactggatcggatggaattccatatcccggaaaccggcgttaccatacgggcaaaagaacgccccatcgtcattatcacctccaacgcggaaaaggaactgccggatgcatttttgcggcgctgtatctttcattacattgatttccctgacaaggccatgttgactcaaatagtcaaagtgcattttccgctggtagaggcccacttgttagaggctgccgtttccgcttttgaggaaatacgttccatacgcagtctccgcaaaaagccaggtacttctgaattgattgactgggtcaacgcactttccttaagcggcatttctccggaaatccttgcaaaagagcttccttttcccggaatacttattaaaaaagacgaagatatggatgcggtaaaaaaacaccgttatctgtaaggggtgccggttatgtttgaagcattttttgttattcttaaaaatcatgaagtccctgtcacgccgggggaatggctttccttgcaggaggctctggataaaggactgtgcggcagcagtctttcctccttctactctctttcccgtatgctcctggtgaaaagagagacagattatgataaattcgactctgcctttgaagagtattttaacggtatccgcaacaacacccctctgaccgcccgcctgctggaatggctggataagccggacatgaatgaactccttcagcaatggaaggaagagaaaaaaatgcttcccggcgaaaacccggaaagcaaagaagacgattcttccaaagaagaaatcgaagaacgcatgaggaaacggcttgaagaacagacaagcgaacacaacggaggggattactggatagggaccatggggaaatcctcctatggaaatacaggcgctcatacaggaggtatccgtgtgggcggcaaaagcggccaccagtctgccttcgccgtcatgggcgaacacaggtacaaagatttccgggatgatcggattatagacaaccgtcagttccagcaggccctccgccgtctcagacagtattcttcccggcgcgatctgccccgtacccaattggatttggacggcacaatcagtaagacctgccggaacggcgggtttctccaaatcgtcatggagcctccccgtaaaaatgcagtgaagctgctgctgctcatggattccggcggaaccatgctcccctattccagcctgatgaatgagctattccaggctgtgagcagatccaatcattttaaagaaaccagattttactattttcataactgtatttacggaaagctgtataatacccctgcgtgtgattatggagactggattgaaacggaatggctgttccataatctcaaagacgatacgaaggttgttattgtcggtgacgccgccatggccccggaagaattgttctctccttccggaaattaccggggtcccaatgacggactgaccggttttgaatggatgcagcttctcaaagaatgtttcaaaaaaagtatctggctgaatcccaaaatggcaaagggaaacgctccctggcgcgaatccgaaactgccgtcaaagaaatattttccatgtaccctctcaccgttaaaggtctgaaagaagccatgaaggagctgatgcggggctgaccgccgcatcagtctattccttcagccagtattcggaaccgtcctttgtccgttccaggaatccatattcaatcataagccgcctgatataaggaaaatcgttgtgtatccgcttgaggatccggttgatttcgatttccgtatatctgtttcccggcttgaaattatccgcaatcttccggagaaccacaagctttctcttttcccttgcagggacttccttaagatgcccgttctcgtcaaagaaggtctgtattatctgttttctttcctcttccgttataatatatctgtcatccaccatcgcagccgtacgatgaggctcacacagcttatcctccgtcttcttttccatcttatctcccatctctttcaataattccatcatagccaggaatgccctggcctgccgctccttctcccgcagcttgaaccggtgattcctgactgtagaagcagaaatcttctgtctttccgctatttccttatcactcagcccttcccccatagcctctataacagactgctggatttccgatattcccgtcaatccggaatggagcaggaaatgaagcatggaaccatgctcctccttcagatgaagctgtatcctttttgccgcatcataatattttccatcctttggaaagacttctcctttttcatatatctctccgcaaatcaggcactgtacctctgtccctgtttccttatatccccgcttcagctcctccagtgacgcaccataaaaagcctcatcccggctctccaaactatcataagacattgcttccgcctcctttacctgtttcctatactctcattttccacgcctgatgtcggccggtattgacatcatataacattttcttctttttgtctatatatttacaaacttattttatatttgtttatatatcaacaaacattcaaatcaaaaaattcatttcatcaataccttggccacaccctgttttaatgcgtaaaacataaataccgctccatacctttttacataaaaaattccggagacatgctcccacttatgttaaagtgagaatccgtctccggaacctgtgctttacttcttatgtatcaatcagccctccgtccgcgccttgctgatcagtgtcacagaaacgcataccatggcaaaagaaccgaacagaaaaacaaaatagaccatggcaaccggagtggtactggttattccttcgatattggcatacagcttgtcgtcatgcagaagcgccgtcacttcctttcccggtatatagggagcgctgctgtgcgtattcttgagtttatattcctgcccttcatactccacaatcacttcatactgcgtctgccgcttcccgagcaccttcctgacgatattatccgagcttacgaccgtcgccttgacctccgtatactctggattggtgtcctccatggcaaaacgaagaaataccgccgccacaatgcacagcactgtgataatgctgcaaataaccgctttctttttcatacctgtttttccctttccctatcttcattcttctgtctgatcctggtaagccggctcattcttcaccgcttcctcatcttctgtgtttatctctttaccgacgcataccggctgtaccgtacgctctaccaaaagatgaaatacatcaattccgccgctttccttgattgtattcattaaaaagcccattttccctcccagatccgtaagggaatcaaggccctccatgatgacctcctttccgggagtctcatcccagtgggcttccagggtattttcatcaaaataaagcttcagcttacgtctgcaggcctcttccaggaaggcaaaatcaattttcaataccattctgccgtcctcatccgtggaaaactccccttttgtccctatccggtaaatttctccgttaaaggatacattcgccgccaccgccttcacaaatccaacctccagcgacttcttttccttcccttcatacaaatcaataaacaatcggtttccggatgccataaaaccgattttatgaatgccatccgtaaaattattatgaaatacctgcatcataagaggcatcagccccacctgctgttcttccatttcataaagtttaccattcagataatttatccgcttctgtctcagggtacttctgatatatactgcctttctcttttcccagccgcctttttcaatcaccggcagccccgtacggcggccttccatttcttctattacgtgctgcagcattatctgtccccgcagatcctccggaagtacggcggggggattgaaatcctcttcaaaatactttttcacaatgcccagcagtacgcagttctggaacagctctttactacccgcattagtgactacaaccatattcaaatccggataagcaagaacatcctgccccagcataccattatagttaaaggattcctcccttcctcccttccacagctgatagccatagccataattactcatggaagacggggtttccacatgtcttttaagggacatttccacccaatcctccggaaccagctgctgtcctttccagctgccatgctgcagataaagaataccgagctttgccgcatcctcgggacataagaataatccccagccgccctttgtaatccccttcggacaggtttcccaaaaaaccctttggattcccatgggttcccacaaacggggacgcagatattccataagggattcccctgtcacttccgtaattattgcagacagcatgtaggagttcatactgttatattcaaatttcttaccgggcactccaatgaggccggactccagatatccccttacccagtcatttcctgatacaatcccggtttcattaaagctgacacagcttgtcatggtaagcagatgctctacggtaatatccttgagccggaaaatattgagcaggttcttctttcctccgaaaagatctatcaccttatcctgcagacgcagacgcccttcaccgataagcattcccactgccataccggtgacacttttacacatagaataactggcatgccacatgccagccggatagggttcgaacccgcattcacagatgaccttgttgttcctcacgaccataatctggtggatatccacgttttcatggagcgccaaatccttgaggaaagccgccaaatgcgctgaggatactccctggctttccgggactgctctttccagaggctgttgtccggcctcacgttcaggaaaagtatccccaaagggaaaggccggtttctgcgggaaaaaatctaccttccccacatttcccgtttttctcgcaatgatattccatatcaactccgctactgccaattctgtttttgccatccgctttcgctcctttaatttaaaacaacgaacatccccaggttgcctctttttccattacttgccctatgggaaaaaagatatcccggattacagcatgtacagatatccgtcacactgatatgttccggccggataccggccgataagcaaaccgcctcatttgccttccacaaatccaactggtactttccgttcctcttatctttcagtatctgttcttctgttatggttttcacctttttcatttcttcgccggataaaaggttacggaaggcctccgccacgtcctcgctcacttcatagcagtcctggcagattgacgggccaatacccacaaggatatcctccggacgggaaccaaacgccttctccatggcttccacggtcttcctccccattcctccggctgtccccttccagcctgaatgagacagtccgacagcgcgctttatgggatccacaaacaacagaggcacacaatccgcgtaaaaggtggaaagcacaattccgggttcatccgtaatcatgccgtccacatccgtataatctctgggacgcaggagtcccttccctttatccgcttctgtaacatggcggatattggtagtatgcgtctgatcggaaaacacaaaatcctccggggtacatccaagagccgccgcaatccggcggtaattttcgttcacattttccgttttatcgcctctgctgaagctgacattcatggaccacagatcaccctcgctgacgccgcccagccttgtactcatcaaatgtctgaccacaccggtttcttcaatcgcaggaaaagacagatactccgcaccattaattaccgtctggcgcataaccggacgggatatgtccttccgcttaattaccgttacattatccatgcaatccttttcctttctgtcaataccgccttatataatcaaaagcattctgataccagtttacgcattccccacatattgcaaccacgtcaaaccgtaccggaatgctttcccccagtctcctttggtaaagataataatccgccacaccacatattttcttttgttttcctgttccaaccgattcctccggatagcctgcattcttatttttcctatatttcacctcaaaaaaaacaagatattccccatcccagccaatcagatccacttccccctgacggcatctgaagtttctttccgcgatacgtaccccttttttctgaagatacaggctggccgcctcttcataggattccccgagttcccttttattcattagcaccttccataaaatttttaatgaagcttctcctgtggatcggcgtaggccccagcctcttcagcgcgtcgatatgagctgccgctccataccctttattggcctcaaagccgtatcccggaaacacactgtcatactgcaccatcatcctgtccctggtcaccttggcgattatactcgccgccgcaatggatgcgctcttggcatcccctttgataatcggcacctgacgcatcgggagtccgggaatcgtaaccgcatcgttgagcaggatatccggcttcacacaaagacggctgacagcctccctcatagcctcgtaagtagcctgcaggatattgatttcatctatcctttccggcgaagcatagccgatacccgtggccactgcctccttcataataacctcataaagctcttcccttttccgggcgctaagctgcttggaatcattcagataaagaatactgcagtctttgggcagaataaccgctcctgccaccacagggcctgccagagggcctctgcctacctcatcaatgccgcagatatatccggcatccccatactctctttcaaaacgcagcatggtgaacatccgcgctttttctttttccagcgcttccagcctcttttccgcttttgcgatttcagcctttatcccgcttcgttcatcctctttataggcctctataagctccggaagccgctctgtgggacaattgccgaactgctcttttatctcctgtattttcatctctgatacctgcccttatttcatcactgatgcttcagaacaccgaatttattcagcggccagattcttacccaggccttaccgataatattgctgcggcggatattccccacgctgggatcccggctgtccgaactgttattccggttgtctcccatcacaaagtactcatcatcccctaaagtgatcggttctactgccagtccggcaaaattaatggtttcttttccatagtcctcgttcagtatttgtccgtttatatatatattgccctgtaaatcaatctgcaccgtttctcccggcagaccgatgatacgctttacataaaaagttttctcagcatattgaaaggggaatacaataatatcaaatcgctgcggttctgaaaagcggtaggatattttatccagtatcaactgatcgttattgcttaaagtaggttccatggagctgccgctcacagacgttctctgcccgacaaaggtaatcaaaaggtaggtccccaacagcaccaccaggatgtaaagaattgtactgaaaatttcctttaccacatttttcattttcttatgctccaatctgtttgattacggcctttcaagagaaattcttcccaatctgccgcttctgaaatcatcggtcaccagctgggccgctctgctcaaatccggttcgccgcccttcttgtaacacttacgcctttcggctgccgcctccagcacctgtaccggcgtttcctccccggtaaggccgtatctctccttcagaagagggagataccattcctgcagaaagcttatcaggtcgacggccagttcatccataatgatgatttcatcgttcatggagcctataaatgccagtttcatgccaacgctctggtcttcaaatttgggccagaggattccgggtgtatccagaagctccagtcctttattcagcctgatccactgttttcctttggtaacaccgggcttattgcccgttttagtacatgcctttccggcaaaagaattgataaaagtagacttccccacattgggtatcccgacaaccatagcccgtaccggacggttcagtattccccgcttcctgtctctctcaattttttccctgcacacctcctgcacggctccctgaatagccttcattccctgcccgctctgcgcgttgatttccagagacttgatcccctgctcctgaaaccaggctgtccatgccctgttgcatgccggatccgccaaatcagacttattcataagaaccagcctcgccttattcctcccaagctcatcaatatccggattccggctgcttaagggaattcttgcatccaccagctctataatcaaatctatcagcttgatatcttcctgcatagcacgccttgctttcgtcatatgcccaggataccattggtaattcatgccaaactcctatctgcctgccctgcaggcgtgcgctttttccgcaccttatttaatcggacccatagaattgctgccctcacttaacttaaaccaagccttgcccacaatatcatcccgtgcgacagcgcctatattcccggacctgctgtcctcactgctgttacagttatcccccagaacaaaatactcatcattcccaagctttatctcatgctccgcgatccctgcatccgcaatcaaatcataagtatcatcctccaccggagccccgttcacatacagaataccctccacaatctgcaccgtttcccccggaacagccaccacacgcttcacataataatgcgtattctggttcccgttaggcagaaaaaccaccacatccccggccttcggattagaaagcttataaataaacctgtttatcagaatctcctgcccattataaagcgccggctccatagagaccccgataacactcgtccgtatccccacaaaataaacaatcacaaaagccaggaaagcagcaatcgctatccccagcacataactgagaatctcatgaagtatcgccgtacttattttcttccgtctcctataaaagcttaatcccttagactttctcatccgtaattttccatatcccgtcgtaaaatttcagttcccaaacaatgataccattctatcacgaaatatattcagctggcaagcagacaactttgtgtgtattatttgtcctttatttttgttactgttcactccgtgaccagtaacttattttttcctgtaactacaccagttcccttccctgctttcgttgtgtcctcagccatgggtgtcctcccggtctttccggttcggtcggcacactgcaaggattcctgtaagggccgtataaatacgccggtccttaggttgcgtcctgtgcaaccttagtaccgctgcgtatttatccgagcgagagcgtgcccgcacaggaaccttgcagtgcgccgaccgaaccggaaagatcgggaggacacacccatggctgaggacacaacgaaagcagggaagggaacgcctccgccccaaaagcaaaaagaggcaaccaccacagcggctgcccctcataccgtatccgattattttaccagctctttaaccttagccttcttacctactctgtctcttaaataattcagcttagctcttcttactttaccttttctaaccagttccactctctctacattgggagaatgcagcggccatgtcttctcaacaccgatgccgttagaggtctttcttacagtaaaggtagctctgttgctgccgccctgctttttcaggacaacaccttcgaatacctgaactctttcacggtttccttctttgattttaccataaactcttacggtatcaccaacactgaattccggaacttctgctttcagctgttctgcttcaattgctttaataatatcattcattgcttttcctcctgatttatcggatgttcttaatacatttcctgtaacagaggaccatctcgttttcgcaacgtttataatataccatatcatacctgcaaaagcaagtaaaaattgccatcaaattcttttaggaaatccaatataccgtatctctgccgatacgcagccccagcttttgctgaagcttaaccgatgcttcattatcagtaaagatctgacagaaaggaacccagcccttttccagaatacggttaatcagatgccgttccagcgcttctgcgataccctgtctgcggaattcttcaaaaacctccaggatccccatgctcccctccgcatgcatgcctataaagcctgttagctttccgtccgcaaaagcgccgtacatcattccggaacgaagccgttcttccagataacctttatcatgaaccgcgtgataatgaaaatatacctcctccagataagaagtatccagtgtttttatacaaaaacgggaatcttcttccaaaggagtcttcctggtatacacagcctggacgcatgtattgattaccgaacccttaaaacgcctgcagatactctccttcaggaattcctgatgagccacatataatccgtccttcaatcctctgggaataagggaaaggagcctttcgcccatatcctcatccgcggcggacatcatataagcgccgctcggcacatccctgagcagcacgccttcttcttctccgcacagaagctctgcctgtccccggcgtatgacttcaatcatatccatgtgggctatttttttcttaagcagccaggaaagggctttgccttccctcgcataagcctcatacagatcaggcctgcgctccctggtacgctcctccgactgcaacagacgccatttatccacctttgcatgatcccctgataaaagaatatcaggcaccgttttgccctgccaaacctccggacgtgtatactggggatattccagaagattattatgaaaggattcaaattccgccgattcttcatttttcagtacaccgggaacgagacgggatacggcatctatcataaccatggaaggaagttctcctccggtgagcacgtaatcccctatggaaacataatccgtgacaatggtttcaagaaccctttcatcaatcccttcatagtgaccgcacaaaaagaccagttcgtcctccagagccaattcctgcgccatctgctgattaaaaacccttccctgaggggttacgtagatcactctgggctttttcccgcccttatcaaggattttctcctctacggaacgataggcgtcataaacgggctgtgcctgcatgagcataccggctccgcccccatacggataatcatccactttcttatgcttattctccgtaaaatcccgaatatttaccgtttccaggctgatatggcctcctgcggccgcacggccaagaatactggtattcaggccgcccgacaccatatccggaaaaagggttaacacatggaaattcattccttatttcctcccctgccgtcatttcccaaatccagcaggccatccagcaaatgcactcgcattcttgccttttccacatcaacctcaagaatacattctttaatcgcaggaatcaggaccgaacctccctgaagcaaggttacctcatatacatcatttgcccctgtggtaatgacatccctgagagtacccaatacagctccgtcctctgtttccacagtcatatcgattaaatcggcaataaaaaactcatccttttttaaacgtaccgcattatcccttgttacatacaggctggctttcctgaatttttccacatcattgatgtcatcaagccctttaaatttgagaatgactaactgtttaaaaaattttactccctctatttccagcgttcttgtttccttcccgctgtccagtatcacctgcttcagccttctgaatctggccggatcgtccgtggtgggataaacctttacttctccctttaatccatgagaagccgtaatgatccccacctgcagtctctgctccatcctaatcctccaaaacaaatctaagtttcccattctgaaacaaaaagccgcttccataaagggagcagccttttatcgtatcagatgatttctacatccacatgttttttgtctcccagcgctgccgcttttacaaccgcacggattgctttggcgatacggccctgtttaccaattactttacccatgtcggacggcgcaacgtgaagttctatcgtcgttattttcccatcttctttttctgtaacgactacttcctccgggttgtcaacaagtgccttggcaattacttcaaccagttctttcatcactttccctccattcaaccggatacccgcagccagtgccgatatcctcttcttagcaaagaggtcttatttctcgattcccgctgctttgaagattttgctgactacctctgtgggctgtgcaccattgttcagccatttctttgccagttcttcatttaccttgaattcactgggattcttgttaggatcataggttccgatttcttcgatgaatctgccgtctctgggagatcttgaatctgccacgataattctgtaaaaaggagccttcttctgtcccattcttcttaatctgatctttactgccattttttcttacctccggaaatatttgcttattttttattatttattctcgcgaatgcaatgactgcccgcggtgtcaaatgacctattgcttaaggtcatttggctaaaaaggaagtttaaacttaccctttttgcctccgaaacctcccatcatgccgggaagctgtttcatcatcttctggctctgctcgaactgtttgatgaaacggtttacaacactgatatccacccctgcgcctcttgcaatcctgtgctttctgctgggattaagcagtttggggttccggcgctccgccggtgtcatggaaaggaccacagcctccatcctggccagctgcttttcatccaccatggactcaatatccgcagatttgcctccaataccgggcatcatactcaaaatactggatatgccgcccatattacgcatctgcttcatgctttccaggtaatcttcaaaatcgaatttccccttcttcatgcgggatgccatctctttttccttatcggcatccaggtccatgcttgcctgggctttatctattaaggaaaggacgtcgcccataccgagaatccggctggccatcctgtccgggtaaaactgttccaaatcggaaagcttttctcccatacctacaaaaagtatgggctttccggttactgcttttacggaaagagccgcaccgccgcgggtatcaccatccatcttggacaggataattccgtccacgcccaccttctcgtcaaattcttttgccacattcacggcgtcctgtccggtcatggcatccaccaccagaagtgtctggtgaacggtaatgttctccttaatttcctgcagttccttcatcatatcttcatcaatatgaagacgccctgccgtatcaaggattaccacgttatttccattcttctgtgcatgctccataccggccctggcaatatccagaggcttatttttcgttcccatggaaaaagcatccacattctgcttctttgcattgatttccagctgttcaatagcagccggacgataaatatcacaggcaaccaacagaggttttttgcccttcagtttaaactttcctgcaagcttggccgctgtagtcgtcttacctgcaccctgaaggccgcacatcataatgactgtggtcgacttaccgggctgcatggcaatctccgttgtctcggaacccatcagagcagtcatttcttcatttacaatcttaataaccatctgtccgggattcagcccgttcatcacatccgtgccgatcgctctggcttctacagacttgacaaactgttttaccacacggaagttaacatccgcctccaaaagagccatcttgacttccttcagggctgtcttgacatcctcttccgtcagccgtccttttccgcgaagatttttaaatacgttctggagtttatcggttaagctctcaaatgccatacacacaatttcctttgctgattctttacagttcttccaaaatgtcatccgccagctttttcactgcttcttcagatgacaacagcttaatttgttccagcttttccttaatattcctgaatctctccatcaggtgcagcttgctttcgtattcctccagcgtcttgtcacacctttttatcaaatcatgaactccctgcctgctgattcccgcttcctgggcaatctcgcttaaagacatgtcgttcataaccacatcctcgtaaatatggcgctgatgctctgtgagcagttcaccataaaaatcatataacagaccctgttccactatcttttccattttttcccatcctgtgcctgttatctgtttcctttacgctgcctgagcagactctgtccgcccgctgcatggactatcttactatatgaagaaagaggtgtcaagtattttttcttgacaaacttattttttgacaaacttatttttacaatagcagttcatagctaaggcacaatccagtgtgactgtgccttgatcgcctgcgccccaaatcagcaattttttcatctataatatctcctttacagtgcatatcgtttcatggcattcccaacaaccggaaagttgcttgttcaagacacagcaaacataaattggacatacacaatcatcaaattcacttgtccatagtggctttccggctgttgtgccgcagcctgaacatctatgagggagttccacgcagcattcacaattcattccacaatatgcctttttcatatagttctcacctcgcataccaatatttacaacaaaattacatatatattaaagactatccttattccgcttgctgcgtctgtacttaatgaaaaaagcgatagccgccgcactgaacaataatgcacagcagcaatgcagcactagcaaaatattaaaaattcctctatggttgtaggtttggggaatagtaatgatccaaatcaccgcacctatctccgcaccctttacccctaacccgtaaactactcttatattgtccgtgctaatatcgtttgacaaggaacataataacattatatactcggaatcaaggaatagaaagaaagcatattgtcatgatataacacgatattgttctccgaaaggatgtgcgatgacaaatgaagtatgaattacacaatgatcttgatgcggattttccgcttatttttggatgcaggatactctctgccagtcatcctgacgatgcatatctccactggcacgactgtatagaggtcgtctattgtgaatacggacagggttgggtaatttctggcagtgaccgaatttttgtgaaagagggagatattgcgattgtcaattccggagatatccatgatggttttacggaatccgaatgccgcatgtattcccttgatttggggagtactctatacagccctctggggctggatccacatctgtttgtttttaaaaaaaagataaaagatgcccgaatggaagcatccatcagacgaattatcgcggaaatggaaagaaaggatgcttattacagacaggctgtgcagatagaaatcatgtctattgtcatcctattaatgcgggagtatcttgataatacgaccgaacggaaatcatcggacaatcagcaggtacaggcagtaaaaaagataatttcgtatctgcgtgagcattttcttgaacgcattaccatcgaagaattgtgtactgaaaccgattacagtaagttttatctgtgtcattcatttaagaaaatgacaggtaataccattattcagtatgtaaattttctcaaatgccagtatgcgagaaacttactgctggagggaaaccacagcgtcagtgaaagtgccgctttaagcggttttaacaatgactcctatttttccaaaacatataaggctgtttttggcagacttccttcggatgatctgcggttactgccttaagagtagaaattttcagatacgctctggcggctggcagggcctgcaaagccttaatccaagcggctttttagggctaaaagctaacagatcagctcccgatttcatgtgtgtttcatttccaaatgctctgattttttaattagcgagttcaaccttatttcccgcccttttccaatcatggaaaggggcggctccggaggatatatacccaaaggagctatgttgaagggatagcgacatcctccggacaaaatgtccagaagtgagcgggataatgccatcgacagtacattcccgccttgtccatatagttgtccactgcatacacaaaaacgccgttcattgtctccaatggcggcgtttagttgtagtctggcacctgtattttctgttgttttattatgtccttgtaaagaacttttaaatattatatgtttatcatatcaatttatattattgaaacagcccaatattattttataattttatagatgattcctttttgtacgactaagataagcgtctgttgtttcctctttcccttctataatgcgaaatggttcttgcaggttaaagcacgccccaaatccaaattactgccaaaagaaaccggaaggcctcccctgataggatgaaggctgaaaaggcctgaatcatactctaaaataattcagggatatcaagaagaatcaggaatttgttgagattctctgatgtcttaacagaacagactttttatgctcaagatattttaatgcaacattgctattttcctgacaaacggtatgcgatcaactgcaaatgcccccaaaagactgactgtaaaagtaaatatcgttaagattggtactgaaataatggctgggtatgaaatagtagtaataccgataagatttaacttttctatcacaaacatatggaacatataaatgaaaaaggtataaccggacagtttttgccatatagaaacccttttcaccttattaaataccttaccgtatttgaagcagataaaaatagctgcactcataataagaatattcagagaagcaggactgaaccatctctctacatatgcagccgtccctatactgtcacggactgtcagccaggccgtcgcagccactgccgcaattcccattgcgtaaataatccatcgggtttttctcttaatatcagtcacgttcagataatatcctaataagaaatagccaaaattaccgacaaggatatccaggccaaggctgtctattctcgcctggattgtgtccagatgaaatatatctgtcagacagggcagcaggaatttgaatactgtccataaaatcagataatactgtaatacatctttttttgcacatatttgccttgctattggaatcaatatgtaaaagccaatcagtatttgaataaaccacatatgggtatgtccaaatataaaccgctgtaccgatgctgcccatacttcctttgaaacctctccgcgaagtgcatctattgccacaccttgaaaagcgtaaaaggccgaccagacataaaataataccagtaatttcagaatccgttttcctattgctaaattttctttttgtggtgaaacaagaaaaagtccgcttaacataaagaaaacaggaactgcgaaacgggttaagctattataaattgtcataattaaaaattctttgctatgtacatcaacaacactccagtaactggctgatacatgcagcagcactatagaaaaacatgcaataactcgtaaaatatcatactttgcaattctgttcatattttcccctcattattttgtaacttgattttcttttctgtatacttctaaaaatcttccgcccagaaacgggcctattctgtcaaccaatttatagttatccggcaatataatacgataattcagagaatgtgcattgtaataaccttccggtatcgtatcaacaataaaatttctgatatcatttctttcagcaagattatgaaaacaggaaatccacgtttgctctgtagatccgtgcataaaattaagcgcagtcagataatcaacaggctcctgtaaatttacttcgtcaaaactgcccacataatatgtactattatctttgctcagcattttggcagctcttatcggctcttcatgaatatcaaatccaattttaactttcgcattgatatgatggagcatttcacccagtccgcacccaatatccactactacctctgcatgattggcattcatatattctgccgcagcctgtatgtattttcgtaattcatagggactggtatgccaactgtcaaaatggtatcttttgcttaatcgtttatatctttctcttttcagaataccaactatgcaatttccgatccctacctctttaactttgcttacaaaatgcagcatacaatcccctctcttttatcagaacaagaatttttcccaaaccaaaatacctcctatatagtctcattttcttttcgccgcttgttcagcaccccttctataaacttcgcggtatacccaccagctcttgcaattttggcacgttcgcgccgatctgttgtctgcttcgcaagatctgctataaattcaggacgatacagccgcatgggacaatcaattttgtcgccgcggaaatatttaaacaatttcagcattgcatctcggccaatgagttcgaaaagttcaagatagctgtcatttaatgcttcagcttcattcccctcgacattaaatgcccggtaaacagcttcttcatttacattatccaaatcaatattaatcattttccttcacctctcacttttatcacagattttagcaattcttttttccataaatccagttatgaaaaggaacttttaaaggctctttatattctcctttaaaagttccttttccatttttggatcataaaaagcccctatgccaaaatcagcacaggggcttttatagttacataaacataatatatcgttattcacaccgcatatacggtgtacggtatgtatcgtaccagtataagtccctattcacctcctttcctaatcctttcctctctttaagacgaatttttctccttcataagttcgtatcgggtttcccctgacgatccgattatgctcacgccaagcagcattttcctgtttttctttctgttccttctgcaatccggaaagcttttcctgcagcctctccatagccttctgcttattcagatactggcttcgttcctcggtggactgggatacgagcccagtcggaatatggataatccgcacccctgtttccaccttgtttacattctgcccgccttttcctccgctatggaatttctcgatacggtattccttatccaacgcaacctcagactgttccgggatgacgctcatatctacataccagttttttcttttatggttcctgcggaacggactttgacaaatccataataccgtcccttcaaggctgctcagattatgctcagtccgaaaacggatggaatcaaagcagcctttctcaaaaccctttgtctccgatactatttccaaatccccatattcctttttcaatgcctcgaacagttttgcgaccgccagctggcattcggatggtccctgacccgcgctgatttgaataatcatactctgttttctcctatttggggtttcctgccttaaaattatagacaggcttcaatatctctgttacttcaacactatctttgatctgttccgcaatttcctttatagaacgataggcaaaaggtgcttcatccagcgtttctgtaccaatacagctgctgtaaatacccttcatttcctttttaaattccgatactgtatgcgggttctttacgtcttcacgtttcatttttcttccggagccatgcggagcagaataattccattcttcatttcccttcccaatacctaaaatagccccttctttcatattagccgggataattaccttttctccttttcgtgcagaaacagtacctttatggagtattcctgaagtatccagataattgtgctccgccgaaaactgttccactgctttccacttcattccctttacgatttccctgacgataatctgtctgttccattctgcatacttctggataatctgaacatcctccatgtaatccgtcctgcccgttccttccagatagctcatgtaataggggatttcttttccctgttccttcaggcagctgtttgccaacttcgtatagtattcggctacctcctcccccaaatgtctgctgcccgtatggattacaagatacatactgccatccgttcccttatcaagttcaataaaatgatttccgcctcccagtgtaccaaggctcctgtctgccctttccctgttgatatgtcccagacagtgcagcccttcgtaagaaaattcctctgccatgtggtgcggctctttccggatggaaaagcctgatggtatcttctcacggatgaccttatccagcttttgaaactctatatttgcttttttcagctttacacaggtcatgccgcagccaatatcaacacccaaaagctggggaattattttatccgttaccgtcatggaaagtccgatggggcccactttgcctggatggatatccggcatcagacggatgatacttccctctgcaacctcgttgtcacatatcattttaacctgtgcttccgcatagtcctccacatcatccgtaaatatttttgcctcggcgtaaatacctttcactgttttcatatactatttctccctaaaaatgggtacaaaaaaagcacctcaaaggtgccctttgcaaatcctttttctatacagctaatacagctatctattgtatacaaggactgccatacctttgattgtcagtttctctctattgttttgatttttgctgttccgctgcatggcaagccctcctttcatgaatcaatcttatttgtcagtaacgaatttatgctaacatataaattaagcatttgcaagtgtaataattttgcacagtcaataaaatataaatctacccatttatcttacgcagcaaatcttcatataattgattgctgatatgcctgccgctatttttcagaatatcaatgcattttaaaatttcttctctggataaatacttctctttataagcaactaacagcatgcctatagttcccatcaaatttattcccatcagctttgctacttggcgtcccttcgcttcatccatcaataaaacatccgatgaattttgatcagacagaataatcgcttcactttcacccatatcaagtccggtcgatctgcgtaaaagctctactgccttaatatctgcaacacttacttttttgataaaaggactttctctaatcattttactttcagcaggaaattttgtattacttactaattcataatatactgcttccggcacctgaatttccccaaacagattagcaactaaatccagcttcccgatcttcatcaaagaaattaacggtgttgtatctgatactactatcatacaacaccctccttcaatttatcccacatatctatctcatcttccacttcttcaatatcctgcgataaatatgctaatcccaactcatcatatatttcgatcaggctatacttcgaaatatctaagatttctgccgccttaccatgggaaattgttttattgctgatgtatggatacaataaaagagcatttcttacaagctcatcatgctgatttaatggggttaaataaagcttcattccttccggcactttaatattcacatccgtcaatgtcataaaaccactccttccttatttattatattataccagagcccttccattatttcactattttattctatgatattttttataatctgtgccgaaaagaataagccctcaattccgtctctattttcagaatataattaatataggcattcttaattcttcgagccgataatcccatacgatttgccaaggtataaccagaataatattctattcgtttacctctgtgtataatatatttatggagtgctattgtatctgttgataacgaaattacttcactccaaatatctgttttggtgaaatagtagctcccagctcaaatctgcatataataccttcatctgccagctttttcaaatgatttaaacaacaaattatttcgtaatatattcacagaccactttagcatcccgtcgataaccaccgtgataggaagttcaggaaatcacaccgtaatcattcccgcaatccgggcgcaggaggcaattattctcctacttcccggacaatattattaaatactttatcgcattctgtatcgctatctttatcataaagttactgttcgttcatgcatcatgtctacatacatataaaagggaaccactccattaagcatcctgcaattatttcatgcccggttttatttggatgattcacactggctaaatattcactcctgcaatgtccagcgccaaattttaaatcaaaagccatctttacatctgccagccctacttcataatattccgccaattcgcggataatttccgcaatagcctcatcatccgtttttttagttccagtttcatagtaaatactgccacagtcgggtgcaggggtaatcaacaggattttacattttgccttcaaagcatactcaatcatctgtctccaggaatactctatttgtgtcttttccaaaaacatatcatttctaccataatcaagagtaattatccctggcctgtgacatagcacatcctctttaaaccgcaggcttccctctaacgaattttccccacctttagctgttactattatattaataaccgaatgtggaaatctttccgcaagcttttgatgaagaatatggggatatgcagcaaaaggcattgtgatattgcctgccatatagccgcagggaatactatgcccatgacagacaatatccaaacttttattatcaggccattctttttccaaatcccttgtttcattgtataaataactgcatttgtcagcaagcatcctttatcttccttccgctattgattgtacgaaatcataaacaatatccatgatcccctgttgataaaaagcatccgccccatgcccctcttgttccaggacataataatccgcccggactccggcttcacacagtttttcatacaacagatcactctgttttatacttaccatatgatcctccgtcccgtggaaaatcaaaaacggcggggtatgtttcgatatataattgactgcactggcttccctaatcaattccgatcggtttccttccacgccaataaattgctcttctgcgccagccgttaaattactgttacccataattcctccgaaggccatatccaccactccataaaaatctatcactccccggacttcattgccgttatcactgtcttccatcccacattctggttttcctgtaacaccagctaatgccgctaatgcccctcccgcagattctcctgcaacaaatatgttatcagcatcggctgcatatctttccgcattttccttaaaatacctgattgccgacttcacatccatgagcgcggctggaaatacggcctcattacttgtccgatattcgatactcgccacaataacgccctttctggcaaattccatccattgaggcaaccatacatctttatccattaccttaaaagcacctccgcatatccaaattagcaaaggatatctcattcctgattccctgactttcggcataacaatacttgcctttaaatcccgaaaggttgcattataccagtatggaaccgttgcataggttatattggtgaccaaagaccaacattccctctctatttttactttcatattcttcttcattttttgtatctccttttacctcttcttaatattccagagggaaactgatttttatcaccgtccctttttccacttcactttccacttcaaactgataggcatctttataaaacaaggataaacgatgacaaatattttctatactaatggaatgaatttcggaagtgtgtctccgtttttctttctttttcatgatctcctgaattttgcattcatccattccctcaccatcatcctctaataaaatatggaaataattgtctcttttatacactgtcaggactattacgccaaagtctttggacagcactccatgattaagggcattttcaatgaggggctggaggataagcctgggcatcgcataagaatataaaatttcatccgcctgaatatccattttaaaccgaccgggataacgtatttgctgaagttccacataagtttcaatatccttgatttcttctcccaaagtggtaataattccgttaatccctgacttcatattattctgaagaagctgaatgaacaacttgagtaactgttccgccttttgcgtttcccctgctttggaaagatagattgcagaatttaatgtgttgtaaataaaatgaggatttatctgcgccatcagtatgctcatctgcaaatcggccctctctctttccgccaccattaagtccctcatctgtttttccaggctcaccaccataccattaaaaatttccgtcaatgttccgatttcgtctgtattctctgaatgtaaatgaacatccaaatggccctccgatatctttcttgctgcattcgttaaagccgttataggattaattaactgtctggaaatgaaaattacaacaatggatgaaatcggcaggcttactaaaaataataataaaaagaatagaaaaatatttttttcctcattatgtaatctggaatcaggcataaacataatgagccgtaaatcatttttcaattgtccgaaaagaaaatatccgttctttccctctgtaatttttaatccatcttcctttttatcattagctgaatccatatattcacggatttctgaagttttttctcctgattctgccagaatttcaccacttccgttcaaaatagcacaccaggaaaactcataattgctttcatataccagactttcaaaagaagcctgattaatatgcagcaggatttccccgacagattcctggtttgtataataattaccaaaattgcaggcataggtgataatatcattataacaaacatttcttgcaatcaattcatgggctccggaaaaacttctgttttgcttctgttccatcatttggcggaaccaggaatcatctccaacagaatgcagggaattcaaattactggcatcactggtatatacatcgccattccacaaaaccaattcgatacatacacagtcatttcttaataattcatattctctgagtatcgaataaatattttttgatctttttactgattgtgcctccgatattttcttatcaatcaattccttctgaagatctttatccgccgctattattattgcatactgcctgagatcattttcatatttttctatttgcttcgcagtaaaggaaagaacgccttcataatcctcccgcattttttcctgcatggaatgtatcatataccaggccgaaaagccataactgattaaaatgagaaaggtaagcagagatattactgtgacaacgaatttcattccgatagaactctttaatccggcaatatagttaatcattttgctgttccttctgtccttttcccattcatggcagttatctggttcctgtttttattagacttatattcccccggggaaattcctgtcaattggtggaacaccctgcaaaaatgctggctgcttataaagccacattgttttgccgcttcataaattttacagttattatcatccagaagttttttcgccatatctattctatagtttaaaatatattcctttatcgtacaggaatatcttctcttaaaaagataacgtaaataaccatcactgatatgcaacttttctgcaataatcgtacttgatagatcttccgcataatggcacatgatgtatcgcaccgctttttccgctttgtcatctcctgttatatccgccgctaaatttttcccttcctccttttccaaaaataattggcagactttcaggaactgttctatagacgcaaccggcatttcattatcgatcttttccaaaaaatcccctgcattcagctcctccgcaagagacctgtaaatttttatgttttctgcacctatataccagttttgattttttcccctgtccagccacccggttatatctttacctctctctgttaaaccgcatttcttcccatacaaatcatccgggatcaattccttcaattcccggcagtccgccgccataagaaaagtttttctttcccacagaaaacatggagatacctttttcagccttctgcatacatctaaaaaatcagagtctctgctaaggaaatcgctgaaataacaaacagcctgcttttttacagatattctgctcctccgttccagttcccccgaaaaatctaacatatctttatgaaataaagacaaagcagacggccttttatattctaaaataattccatatgtgtatttttcaagccttgtaaacgcttttatgacaatctttgcagaagaaatatcatggaaatcatcttctttcaaataaactttttcttctttccccagaaagaccgcataggaacgaagattcaacataacaaaaatataggttgctgacggactaatccatttattggttgtcagccctttattttctgttttctcatcttcccatatggtacgaagccagtcattccacatcactttttcataatgagccttggaagatatattttccccgattttctttagcacctccgcaagcttatcttcattgatttcatgttttacaaggaaataggagatccctatctgaatcgcttctttcacatattcaaattcctgatatgcagtcataattacaatattggtatccgaaaagatatctaaaagcttcctgctcaactccaacccatccatcttgggcattctgatatcaacaaaaacaatctctggcttctctctcttaaaaagttccagggcttttgttaccgtcaaagcatagcccgtaattttgcaaccaaatttctcccaggcactcaggcttttcagatattcaatagataggatttcatcatcaataagcaaaaccttattcatccgctactctcatccctttaccgccccttctgtcagtccccggataaaatctttcgaaaatacggcaaaagctgctatcagaggaaccacagatatcagtagccccgttatctgcgccgcaatatctttcctgtgttcatttcccaatgactgtatgtatagtggtatagtatagttatccgccttgttaatcatcacaaggggaagcaaataggaattccatgaccacaaaaaaattaacaagcataaagatataatcgcaggtttgatacaaggaagcacaatacgataaaatatcttaaattcattacagccatctatacgcgcactttccactaattccatctgtaaggagtttttcaaatattgggttatccagaataccccaaaaccattcgggaaccaaatcaatatcaatggtgccagagtcccggataaatgaagtactctcatttcctgcatatatcctataatccccagtacggatggcaccatcattgtaagcagtacaaaattatatataatcttttttactcggaactcataagccgccaaaccgtatcccgccatcaggctgatacttactgaggctgtcatagacaggagagaaaccaggagactgtttctgaaagatatccagaaggttttattcagggccgtagcaatgttttgaaacagatatttcccgggaagaagggatagcccaagcattacctcgtccgtagaatgcgttgccatcaccaccgtatagtaaaacggaataaaagatattaaagataccagggtaatcgctattaatctcgggatattttttattattttatgcatctgttcactctcccttctctctgaggaatctcatattgataaaagaaataatggcaattattatcagcatgctaaaagcaatggctgccccatagccatatctggaattattctgaaaagaacaatcatagaaataccatactatcgtaagcagtgtcctgcccggtcctccgacaatcgtggaacctgagccggaaaccagtgttttagcctcatcaaataactgaaatcctccaatagcgccctggaccacaacaaaagtagtgataggcctaagcaatggtaatgtaatcttaaaaaacacttggacagcattcgctccgtctactttagccgcatcataatattcattgtttattgtggataatcctgaaaggtaaagaaccataaaatatccaaagtttttccagatacaaattaatattactactataaatgcgtatctgctatcccccagccaattaattttatcggtaataattcccatcctcataaggaatccattcaccgcaccaatatttgtattgaacatattcgcaaaaatcaggccaattgccaccggcattgttatgtatggcaggaaattgatcgtttgtattagctgtctgccttttatgatatgaaacatcaataccgctaccaaaagcccgctgataatcgtaagaggcatagcgattatcataattttaatcgtatttaaaattgatttccagaaaagaggatcttttgtaaacactcttatatagttctgtaatccaacgaaagttttttcatttaattttactgccgtccaatccgtaaagcttataataaaagaataaagcataggatacatataaaatgacagataggacagaaggaaaggcgctataaataaatagggccatttccctaatttttttatttttttattttttttcatcgctccgccttttaaataagcgggaatcgtatttccgccaattcccgcctctgtctttttcttttacttaatcgttacatccggtatttttgcctgtaaatccactttaaattcttccatcgcatcagctgccgacatgccaggatctgccgccatcatttgtaccaccatattaacagaatcagataccagattatcataaatggaaaggcttgcttccggaatattaggagcgatttcctccatcataaatgtatttatctcctggtccccgaaattcggcctggttccttttgtgtaatccggatcttcatagagggatttgaccggaaggaagaaaccagagccttccttcatgtatttcgctccttccgaagtaagcagcacccaggaaatgaaatcccatgcttcttctttcatatcagaattcttataaataccatagcaagttcctccccagccaaatccgccctcggccggagtaaacattccccaattatcaataccctcaggatcataaggttctacccagaaggttacgctccaggaagctcccgggaagaaaatagaggttccatccgcaaatgcgttagaccattccgtcgaatactgtgaaagatttccacaggcttttgattctcttaaattctccacagtttcaaaaaccttttctaccttaccggttacgttaacatccccattttcatctacattattgatattacgctgttgttgcatcatcatatttgagatatcctgaaggccgggaaacaaagtaacacttcctccgctttcctcataaatcctggctcctgcctgggcatagtcctcatatgtctggaacattttttccagttcttctctgtcatcggttcccagatactttctggccaaatccttcttatacatcataaaagcaggattcaggccattttccacgccaataacctgatcattggcattcacaatagaggttattgtagattccagcagtatggaacgatcaaaattatagggagcctcttccaggttttcccatatatccaaggcaaatgcactacctctccagcccatctccgccataagcagatcaggcatatccccgccggaagcatatccctgctgaagcttcgttagataatcttcggcagccactaccacctcttcaaactcccagtccgcatccggatgtgattcgaaataagcatcctgaacagcatcaaactgccctgtcgcccatgtccagagaaccactttcttcttctcaccgtcattactactttgtgtcttttcagacaattcttctgtttggtcggattcagcttgaaccgcttcatccaccgcctgctcctgtccccccgttccgtttcctgatgaagcacagccgctgaaaagtccggcaatcatactcactgtcaaaagtaccgataaaatttttctctttttcatgtaatgcctccttcataatttttatataataatcataacaggcatattcatgatttttatttccatttttgtatattttgtgtctaattcgtatatttgtatagtaaaccaggaatttattaacagatgtggaagctttataacttctcactgaagatattcttatatccttccccataaatctccgtagcgctggaaacaatcataaaggccagaggatcctcttccttcacgatttcttccgccttaggagccatagtattgcgcatgacacacataatcacctgcttgggattattgctgtatgctccttttccttccaggtaagtcacgccgatgtccagttcctccagcagccttgccgtaattttttccgaacagtcgctgataatataaatcagcttagcctcgtcccttccataaaggactgcatcaaacatgatgctgcagactaccaccgccagtatggcatacataatcgtgtcaaaatctccgaacacaaaaagggatgcggatacaatcagaatatctgtaacgaaaaaaagccttcctgtcttcagatgtttatatttcagccgtaaaaattttacgatgatatcggttcctccggtagtcgcaccggccttaaaaacaatccccaaccctattgccatcaggattccgccggccagggctgccagcaaaggctgtgacgtcagcgccccgaaacgcgtaaaataattggtgaataccgagcacataaatgtggcataaatcgtagaaatgataaaacgcaggccaaatttccataatcccgctataagtataggtatattgatcaaaagcatgcctgtacctgtaggcagcccggtcagacgattaataataactgcgataccggtaactccgccgggtgccaggttattgggatccagaaacaggctgatactcacgccataaatacatgctgccgccgtaatcatgagataatcaaatatccgcctctttaccgtcttcttttccttaaattcttctgccacaatatacctcctagtataataatggtgtagtcaagaacgactactaagttaaaagttacaaagtccaatctaatcaatctatatagatataacggaaggaggagttctccctccatcagaagttataaggcaaccttatttaccttgcctgaggtttccttcatgcaccagacaaaagatagaggtataatcacggaaggcaggattatggacgtttcctccttgggaaccggccttttggctggtgaaacctctaaaaaagtctgtcagtccattcggtggtgatttatgttttggctggttgggatgccccaggctatacctgtataacccgctaggttgtgtatccaccttctggaattggatacctgccagaaaggatcaagttatgcactatcaaaaagttctcaagatgctggaaagcatcccctatctctctgtagggcttgatgtcggcgctgatttcacctggatgtccatcatgctcccaaatggcctcctcactggaaaaccctttaagatcatccactccgatccgcagtcccgtgagcttgctgtcacaaaaataaaggaagcacaagagacgtattctctcaaaagccgctgcttccttgagtccaccgggatctatcacatcccgctcctgtgcttccttcgtgataaggggtttgactgctccgtcattaatcctatcatcactaagaatagcacaaatatgaacgtaaggaaactgcataatgacaaatttgattcaaaaaaaacggctagagttggactggatgcttccctaaagacttccatcgttccggacgatgagatcatcgacctacggaacctggtccgtgattactattacttcaaagacctacagtcggcggtcgttctcaaactacatgcagaactgaaagtttccttccccgcttacctacaggtgttcagtaagatcaccacgcagacttccttaaaccttctatatgcataccctcttgccagggacatgcttgccgctccaaaggatgacatcatcaaaaccatccggagcacagcacgctttggggaaatgtatgcccttgccaggtatgacgccttatacactgccgcgaaagattccgaattgttcgggcgcgcccttcccagcaatgccctccggattaggctgtacatagattcttaccgggaataccaggggcatctggactccattctgcaagaactgcacaaggctgtagatagacttcaggggaatcctgcatataaccgcatccgtctcctacagtccctgcgcggcatcggctttttaagcgctgttgtcctaatcgcagaaatgggttcctttgacttatttccttcacccaagaagctctatgcttactttgggttggatcccggtgtaaatgattccggcaagctcaggggagacagggtccacatgtccaagcgggggtccggtcttgcgcgtcgtatcctgcatatgattgccataaacaacttaaaaatggagaaagggataaaaacacctgtaaacccggttatttatgactattacacccgcaaatgtgccagcaagaaaaagagggttgctgtcggagccgttatgcataaaatctgcaacatcattttcgctatgctgcgggataacaaaccttttgagatcattacacccgaagagcattgtaaacgctatgtgacagaacagtctgccaaaacagaaacagcagcttaaagatccaccactatgaaatttttaaattcccatatccgatgggtttattaaagtcgcctttttttacaccaactgctcaaaaaaactttttaaacatttttcactttatttcttgacatttcttagctggacttcttaaatacggccggaaatggaaaaaaccgcataataatctcacgcggtttaatccgtgcagcatcctgcacttctttcctatcaacacaaacaacttccggagaaaaagaaccgtccggatcattttctgcattctgtctcttaaatattcgttctcacgcttttgggtttatagccttctctttcaagagcggatatgatctgctgcttatgttcggttccgaaggcttccagtgtaatccgcagctccacagcagcgctgcggttaatggaaacaaactggttatgctccagcttgattacattgccgttttctttggcaattacatctgccacgcgggataactcgcccggtttatccgggagaagaacggatacggtaaaaatacgatctctgaaaataaggccgtgctgtaccacagaagacatcgtgataacatccatattgccgccgcttaaaatggataccacctttttgtttttcacatccagatgcttcagggccgccacagtaagcaatcctgaattttccactatcatcttatgattttcaaccatatcgaggaaagccactaccagttcttcgtcctcaatggttatgatttcatcaatattctgctgaatataagggaaaataatacttccgggggttttcacagccgtgccgtccgcgattgtgttcacatgatccagagttaccaccttgcccttttccagcgatgcctgcatacagtttgctccggcaggctccacaccgatcacatggattttgggattcagcagcttggcaagagtggacacaccggtagcgagtccgcctccgcccaccggcacgaggatataatccaccaggggaagttctttgaaaatttccatcatgatggttccctggccggttgcaaccgcgggatcatcaaacggatgaatgaaggtgtagcccatttcttctgccagctcataagctttggcacaggcttcatcataaacatctccgtaaagcacaacctccgccccgtagtttttcgtacggtttactttcattaagggtgtcgtggtaggcatgacaataactgacttgcagccgtatgacttggcagcataagctacgccctgggcatggtttcctgcagatgcggtaatcagccccttgccgcgttcctcctccgtaagcgtgcttatcttgtaataagcgccgcgcagcttataggctcccgtaagctgcatattttccggtttgaagtataccttgtttcccgattggttgctgaaatattcactgtataccagtttggtctcctgtgttactttttttaccacctcggaagcttcttcgaatttctccagggtaagcatcttgctttcttccattttttcctccattccggtgtctgtacggataaaccgttccgcgcaggtcctggtgcttttattcttcttctgtttttccgtcaaacagggcgttcacgaactgttccggatcgaatttctgcagatcctccatatcttcgcccactccgatatattttacaggcacattcaactcagactgtattgccaccgcaatgccgcccttggccgtgccgtccattttggtgaggataataccggtcagttccgccgcctctccgaattcccttgcctgggcaagggcgttctgacctgtggttccgtcaagcaccaccagattttccctgtgggcatcagggaattcacggtcgatgatgcggttaatctttttcagttcttccatcaggttctttttattatgaagtcttcctgcggtatcacacagcagtacatccacatgtctggccttggcggcattcaccgcatcgaaaaccacgcttgccgggtcggagccttctgcgccgcctatcatatccacaccggcccggttggcccagccggcaagctgctcgcccgccgccgcccggaaggtatccgctgccgcaatcaggactttccttccctgatccttcaaaataccggcgagctttccaacggaagtggtttttcctacgccgttcactcctataaccagaatgaccgactgctttttttcaaagtcataagcggtttctcccacctgcatctgctcgcgtatgctgtcaatcagaagctgcttacaggcagcaggctctttgatatgctgctccttcacctgttttttcagacgatgcagaatatccgaggtggcgttgacgccaatatcccccatgatcaggatttcttccagttcttcataaaaatcatcgtcaatagcagaaaaaccattaaagacagaatcaatcccatttacaatattatttcttgttttattcagcccttccttcagtcgggcaaaaaaaccttttttttctccggaattcttcacatctccagagtttttatcttccgtggaattcttgtattccgtagaatttttgtattccatgctcatatccactctccttcaccgttttcgtcttccattaaagtcaattctctatctctttctcaatcaggctgacacttaccaaagtagaaacgcccttttcctgcatggtaataccatacagtctgtcggccttttccatggttcctcttcggtgtgttatgacgatgaactgggtgtacttcgtcagcttatgtaaataattggcaaacctccctacattgctgtcatccagggcggcttcgatttcatccagcagacagaagggcgaaggcttcagattctgaatggcgaacagcagggatatggctgtcagagccttctctccaccggaaagctgcatcatattctgcagctttttccccggaggctgggcgatgatacgaattcccgcttccaggatatcctcatcctccatcagctccagtgttccttttcctcctccgaacagttccttgaaaaccttatcgaattcctggctgatctgggcgaatttttccctgaactgcttccgcatggcttcatccagctccaggatgatacccttcagggtttcctctgccttaatcaaatcgtcgtgctggtttttcaggaaggtataacgttccataagatttttgtaatcttcgatagcgttgacattcacatctcccagtcttctgatctgatcctttaatgatgtgatttcttttttcatggcggtcaaatcctgaagttcctcattcttaagcgccgccgcgtcactcagagtgatttcgtattcatcccacatatagttgatctgggcttctacggattcttccagcttttcctgctgcgcactcagcctgtaaacttctttatcaagccctgaaagccgttccgcaaggctttccctgtccgcaaaaaagttcttctgcctgccggcaagaacctctttccgctccatatcagccttcagcttctcttccccgctgttctggttcgtataagaggcgtttatggtttcctgcagagccaggatgtcggcctctttacgggctatttcctgtctgcccgcttccattccttcttcgatttctttcagttccgcggtgaatttctgaatatcccccctgatacgatccaggttagtctgctcaaagccctgcttctgccggatcttttccacttccaaatcccactcggacactctggaactatgaagattctcttcttcctttctttcctccagttccttctgggccatatggatcctgctgtccacatccttttccagcagttcagaggcttccagctctctccgtatttcttcttttccgttctggatttcttcaatctgagaagctatttctctctgctcgttctggagatctccgtagccctgttcggtctgttccttcttttccctggcagcagccacattcatcctcgcggtattctgatggataaattcttcctggagcgatgccttcgtctgctcaagctccatccgcagcttgtttcggcgctgtttggtcttttcaatatcatccagcaggacatctatggatttcaaagtttccctgactcttgtttccagctccgccatctcccggcgtcttcccagcagattactgttgtttttataagcgccgccgctgatggaacctccgggattaaaaagctctccctccagcgtcaccatacggagactgtatttatatttgcgggcaatccttaccgcattgtccacattatcaatcacaacaatccttccgagcagggatgctgccacatcccgataccgctcctccgtattcaccagggtatccgcaaggcccagcacgcccggttcggtcaaaacctccttcatgcggaattcctgtctgttgcgaatgcttgtcagcggaagaaaggtagcccttcccgctttattctgcttcaggaaagcgatcatttccttggctgtctcttctgtttccgtaacgatattctgtatgcttcccccaagggctgtctctatggcgacttcatatttcttttctaccttgatcagatccgcaaccacaccgataatacccgaattgctgcttttgcgctccataacacgcttaacgcttcccccatagccttcataacgctctgtcaggtttgaaagggcatccagtctggatttatcctgatggtaaaccacctgggtatcccgcagcttctgatccttttgggaaagctcatctcttatctggttcagttcttcctccagaactgactgcctgtcgttaaacgcggaaatattatcattaatccgcagaaattcttcctccagcttacggatcaggtcctcctgctgggcttcatcggatttcgcacgtaaaagacgtgaatttaattccgccctgcgtatctggatctgttccagcatggtatcaaaacggcccatacgtgacttaatggtagcacgttcattcaatgcggtaatgattgagttttttccattttcaatattcgcatttaattcatctatctgggcctgtactctggcaagctccgcctttgcttcttccctggcttcctccagctgtgacagatgagcgtccacttcggccttatcctccagaatagccgcttcattcctgctgcgcgcctcaatttcccgctgcaggttttcctgccggctcagcaaatggttttcattgcctcttaccgaattgatctgttccttaaggacgttgatttccccttccagctttccccggagcatcccggtatctgtaagctgggaacgttcttcttctatctgcttgtcaagctgctctatttccgcctgtacctgttcatactcttctttgatatgctcatatttggatgttgtttcctgcagatcgccggacgcaatttcatatttttccttcacgcctgccagctgatccttaagtctggcattttccaaaaggaatacattcacatccagatccttcagctgttcttttttcttcagatagattcttgccttttccgactgcttttccaaaggctccacctgtttttccagttcggacaggatatcgctgacacgcaggaggttctgcttttcatcctccagctttttctgagcggcggatttccgccttttaaactttacaatacctgcggcctcgtcaaaaagctctcttctttcctccggctttccgctgaggattttatcgatctgcccctgtccgataatggaatagccttctttgccaatacctgtatcataaaaaagctcgtttacgtctttcagcctgacaggagaaccattcatcagatattcgctctcaccggaacgataaatgcgcctggccaccgtcacctcatcaaaatcaatggcaagctgatgatcacggttgtccagagtgatcgccacataagcgtatcccataggctttcgtatttccgtgccggagaagataacatcctgcatggaggcgcccctcaattgcttgattcgctgttctcccaaaacccagcgaaccgcatccgcaacattacttttaccgctgccgttaggacctacaataccggttattccgttatgaaactgaaaagttattttgttggcaaaggatttgaatccgtgtatctctatgctttttaaatacattagttttaatccttattttctatggaaggctttgcctccatggaatgtattccttctatggatttttcggcttccatgttcttccgcagggccagaatcgcctcataggcggcctgctgttccgccgcttttttggtgcgtccctttccttttccgatgaccctgttattcagcacggcatccaccagaaattccttatcatgatccggcccctcttcaccggtgagcgcataaacaaattcggcttcaggcatggtctggatcatctcctgaagcaccgttttactgtcgtaaaaaagaattttattctccagatccgaaagtacaaaccggtggataaaatcatgggccgcctgaaaaccgccgtccagatacagagctccgataaccgcctccatggcatctgaagtgatggaatccctccctctgccgccggtggcctcttctcctttacccaggagcatgtactggcccagttccagatctctggcgcaataggccagcgcaggctcgcataccatggaggaacgcagcttggtcagctttccctccggcatttcggggttctcggaaaaaaggaattcgctggaaaccagttccagcacagcatcccctaaaaactcaaggcgctcatagtcctccagcttattgattttttgttcgttggcaaaggaactgtgggtcaacgcctgacgcagaagcattttgtcccgaaagacatacccgatctttttctccagcccttccaatgtatattttatactcataaggtcctttccacaattaaaaagccctgtccaggtttccccgctacgggctttttccacatatttttcaaagtggcgcttgtttccagccgcttaattgctgttttttatcaattcaaccgcttctcccaccgtgctgatccgttccgcatcagccgatgaaatttcgattccgaattcttcttcaatccccataacaatctggaaaacatccagggaatctgcgcacaggtcatcaatgaaagtggtgtcaaccgttatttccttgggatccacacataatacttccgcaatgatagttctgagcttgtcaagttccatatccttcgtcctttcttactcggccgcaccggaaatcactttctggattttgccgtttatatcctgttccttaaaggtcacacactgcaggatagtatttttgatctccacggcttttgaactgccatgggtctttaccaccagccctttaagaccgagcaagggagcgccgccatactgttccagatcaaaagccttcagcgtctgctttaaggccggctttacaagaagggctcctattttgcttctcaggttcaccatcatgccgccctttacttttttaatcagtgtggaacccactccttcatacagcttcagaactacatttccgacgaatgcttcacaaaccaccacatccgccgctccggcagggatatccctggcctctatgcttccgataaaattgatatcggaacatgccttcagcatgggaaaggtttctttaaccagcgcatttcccttttcttcctccgcgccgatattgacaatccctaccttcgggtttttaattcccattacattttccatataaatggaacccattttggcaaactgcaccagctgggacggttttgcatccacattggcgccgcagtcgataagaagggaagcccctttttccgtaggaatcaaaggggcgagaggaggacgctccactcccttgctccggcccacgataacctgtccgcctgccagcactgcacccgtgctccctgcggaaacaaaggcatcacacttgccttccctcaccatgtacaaaccttttacaatggaggaatcctttttgccgcggatagccgctaccggaggctccgccatggcaatcacttccgttgcattcacgacctccacctgctcctgaggataggtatatttggataactccgcctttacctgctcttccttacccaccagaaacaccttaatcttcttttccgcgcagacagcatctaccgcgccttttactatctcaccgggcgcattatccccgcccatggcgtccaccgccacttttacataatcagccattttcatatccctttctgtatatcctgccatatccgctcaaacctcgcagccaggctccggcaattcccgcctccataaaggccggccggtgacggacaaagcccacctgcggaatttgagtatcctctataaatatactagacatgcctgtaaaaatcaagcgaattgtccttttggtgtgtccttgccaaatgataattgacataaaaaaagctttcctgaagaattaatatcctcaggaaagcttttgctcgttttctcttcattaagcttctgtgttaatgatctctctcttgttgtaagagccacaagccttgcatactctgtggggcatcatcagagcgccgcatttgctgcacttaaccagagtcggagcactcattttccagtttgctcttctcttatctcttcttgatttggaagatttattcttaggacagatagacattacttacacctccttgttctcgcgaaagatatccataattgctgccattctgggatccggaacgaaagtatcgcaatcgcattttccttcattcaaatcttttccgcagacactgcaaagtcctttgcagtcctctttacagaggattttcatcggccagcatgtaatgatttcattgcttatcaggctgtctacattcagctgatatccttccagaaatccacgctcctcatcctgctcctgctcatccgccacatcgggcgatacagcctgagctgaaaactgaagtgtaaattcctttgttacttcccgaaggcatctgtcacactttaattctaccttcactgccacttctgcttctatggatgctcttccctgcccggtattggtaagagtgagcgtcaccggtgatttttccagtattctgaaatcttcaccctgaaagcatatgcttgtcagctccagcggaacttctttgacaacagatttttcttcttctgtaaagacatctgtcatattgattaacatagtagactcccaacgaatccggctaaaccgaatctcattcgcacttcaacaattatacataaccggatacactttgtcaaccaccaaattcaaaaggattcccggattataccgtgccccagaagatagtttttccagagctgataatacttcgccttcaaatggatctggtcgaaggtatactcggtaaccaaatcgccgttggcatcacttaccgcatcattgatctccaggtaaaagatatcctggttattggccatagcggccagcgctgcgtttctggcattaatattttcattgttgaaaatcttgtccgtatggctcttttccccgctcacacgcatgattccctggacaaaaatgattgcgttcggctgcagctgtctgatccggttcaccgcatccgcatatacggtgaaaaagctttccgtagtccctcttcctaattcattaattccaagcatgatatagatctttccgaactgtttctgggaaagcgcttcttctattgtcaccttagtgccgtcatcaagctgcgccacttttttcggggattcaaacacattatatatggtaagggatgtagccgagtaaaaggttacattatcactgaaaccggcgtattcatcaagccctaccgttctggaatctcctataaacaaagcatcgtcaaaataggattcatccacctgggtaaattcataggtcttattttcatccgcagcggattcctgttcctgtaccggttccgtctccgaaccagtttcctgaccagtctgttcgccgctctcttccgccgcatgattatcggatacgctttccgaccccggcagctgcatgggtatctgttctttctgctgctctgttttatctgtattgatcaattgtccgaacttatcatacataggctggatcgtatttccggaaaccatgctgtttcctgtcagcacattggaatcaaccgcgtttgccgaaacaccgccctcctgatccgccgcattatcagaaaccgtattttcttccccgttttctgctgcttcgtctgccgccccgctttcctgaatctcttcttcagcggaaccggtctcttctgtcagggaatgctctgcctgtgctgtatcctcctgcgctcctgccattgtctggctggcttcatgaacgaacaggtcccatggataaacaccatccttccatccctggaaaaccagggataagccgggcgtcatccatccgtcctgtctgctgtaggaggcatatatcgtatgttcccctgcatatcctgcacctgttattagcaatccgcttaccagaaggagcaggaaaagcggatatttgttccaatttttcatttatatgccaccttaaaatctaaaatacataaacggattatttgccgcattggtcagctggtaaacagccatccagaacagcaccagaagaagcgcattggcataccagcttttcctgtgcttgttgaaccaggcggaaactccgggaatacagaaaaagatcccagccagcagaagccaccagtacatggagaaatacttgaatatatcctgtgggttaagagtctctccaattccgaagaaagggaacagacggccaaaatatattcctaaatcagggagactggtcacggcaaatatcacccaggtaagcggaatcacaatccatacataaatatgggaaaccagcttatggtggctcagccatttgccataaaaaagcttctccacaataacaaacaggccaacagtaatcccccatatgagaaaattcacaccgcttccatgccaaaggccggtaagcagccataccacacacagattaagaagaagccgcggaacccccttccggtttcctcccatgggaatataaacataatccctgaaccagcttcccagtgtcatatgccatctgcgccagaaatcactgacggaagtcgccatataaggctgatcaaaattcttgatatatggcatccctatcatcatgccgattccgaccgccatcagggaatagccctcaaaatcaaagtacaactgcagggaataggtaaatgcccccagccatgcaagcggtgtggaaatactctcaaatccgatagtctgaatatcattccagaggatccccagcctgtctgcaagaagcaccttggcccccagtccaatcacaagcagccggagcccttcctcaaactgctccggtgtacatcccaaatgctccagcccttccgaggcatcatcataacgcatgattggcccgctggtaagctgagggaacatacacacataggaaccaaagctccagaaagaattgtccgcctccacttttccccggaaaacatccatttgataggatatcattttaaaggtataaaagctgattcccagaggaaggagtatattgctgtccaccacatttcctattttaaagaatgccagcactcccacatcggttatcagggccagcaaaagccatttgcgcctttttttatctctccatttgctgtggacaaagggggaatcgatatccaccttcatattcttccctataaggaaattcagcgccgtacaggccagcagaaggagcacaaaccggggttctccgcaggcatacatcagaatacttcctataaagagtactatcttccgatatttaacgggtgtcagataaaaaacaaccaaaaaaacaggcaggaaccgaaacaggaattccagactgctgaaaataaggctattctgactaactatgtttcctaaatcaaatcctgccacattctccactccagacattacttaaagttccatatccgtcttcttcagtcataaatttccgacaaaaaccgaccggatacggcctattaagcataatacattttaataggaatgaaaagagaattttcatatttttttaaacttaatagtttcttaaaataattgtaagaatttcccgagagacctccgggggctttaatcagccgcccggactccctctttcatactgcgtacatattctttcagagcttcccctgcatttgcaccattggccgcaattatctttacaatagcgctgcccacaatggccccgtcggaaacggcagccattttttccgcttgttccggagtgctgattccgaagccgaccgcacagggaatctctgttactttgcgcaccatatttacaatagaggaaagatcggtcgtaatctgactacgcacccctgtcacacccatggacgatacaatatagataaagccggccgcgtcttccgcaatcttcctgatacgttcctctgatgtgggggagatcatggatatcagatccactccgttggaggcggctatgggagccagttcccctttttcctcaaacggcagatcaggaatgataatgccatctacggaaagctctctgcatttttcaaaaaaagcatcatatccataatgaaacaccggattcagatatgtaagaaaaaccagaggcatctgtgatttttccctcactctgcggacaatgtcaaatacgccgtccgtagtcattcccgccttcaaggcccgtatattcgcttcctgtatcaccacgccctccgcagtgggatcggaaaacggtatgccgatttccaccagatccgcaccggcttcttccatatccagaatatattccactgttttatccgcactcggatcccctgcggtcagaaacgcaataaaagccttgccgttttgaaatgcatttttaatcttactcatgaatatccctccctctgtaccgtgcaatagcggccacgtccttatcgcctctgccggacaggcatatgataatactgtcatccgtgctgtactgtgctgcaattttcttaacatgggctacggcatgggcgctttctattgcacagataattccttccgtacgggccaggtattcgaacgcatccaccgcctcgtcatcggtaaccggtacatattgtgccctgtttgtatcatgcaggtaggcatgttccggtccgattccggggtaatccagtcccgcggaaatggaatagaccggagctatctgtccatattcatcctggcagaaataggatttcatcccgtgaaaaatccccagcgtccccttcgccattgtcgccgcatgctgcccgctttccagacctcttcctgcggcttcacagcctataagctgtactttttcatccgggataaagttatagaacatacccatggcattgctgccgccgccgacacaggccactacggcggcaggaagctttccttctttttcaaggatctgttctctggcctccttactgatcacgctctggaaatctcttaccatcatgggaaaaggatgaggccccatcacagaacccagtacataatgagtatccgatacacggttcgtccattccctcatggtttcgttcaccgcatccttgagcgtctgtgtgccgctggttaccggatgcaccttcgctcccagaagttccatacggtatacattcagcgcctgtctgtccgtatcctccttacccatgaaaacctcacattccatgccaaggagcgccgctgccgttgccgttgccacaccatgctgtccggctcctgtttccgctattactctggttttacccattctctttgccaggagcacctgtcccagcacgttgttgatcttatgggaaccggtatggttcaaatcctctcttttcagataaattttggccccgccaagatccttcgtcattttttccgcataataaagcagggagggacggcccgcatattccttcagcaaccgatccagttcctcctgaaactctttgtcctttttataatattcataacattcttccagccggatcagttcattcatcagggtttctgatatatactgtcctccaaactcaccaaaacgtcctttactcatcacatcgattcctttctttatcggctctgccgctctccctgagcaccatggcctctttttccgccagcctggcggctctcataaaatcaacaatttttattctgtcttttcttccggcgctttccactccgctgctcacatccagcgcaaagggttcaaacagccggaccgcttccgccgcattgcaggcgttcagccctccggcgaggaaaaacggttttcccactgcccgggcctcatcggccagcgaccagtcaaagggtcttccctctccgcacccgccgtcaaaaagcagataatccgccgcactgtccttccattccgccagcttccttccatccgtaacctgtaccgccttaattacctttttcccgctttccctttgaataaaggcaatatcatcctctgtctcctgcccatgaagctgtgcggcctcaatcacgccgctctgcaaaagcctgacaatctgttccggcttctcgttcacaaagacacctaccgggcatatttcttcccgcaaaagcctgcgcagccctgcggcctgttccgcagtcacctgtctgcggcttctggcaaatacaaaccccacataatccgggcatacttcattggcatacagaatatcttccacccggctcaggccgcagatttttaccctgaggcttccgttcttcccatcctccctgcaaaaggacgggccggtaaggggcttcacagcttcccccgcagaatatccagttccctgcatttatcaggactccgcatcagcgtttccccgattaaaaccgcatttgtaccgttttcccggaggatttggatatcctgtgccgtcttcataccactctccgaaacaaaaaggatatctgcaggaaccagcttacgcagtctgacggaattggtgatatccacctggaaggtctttaaatcccggttattgactccgataatccttgccccgcaccgaagagccatttccacctcctgccggtcatgggcctcaaccaaggcagaaaggcccagactgtccgcaagcgcaaggtaactcttcagctcctcttccgtaagaatcgcgcagatcagaagcaccgcagccgcacccagcagctttgcctcataaatcatataggcatccacagtaaaatccttgcgcagtaccggaatcgaaaccttgccggcaatttccttaaggtactgatcacttcccagaaaaaaatccggttccgtcagtacggatatcgcagaagctcctgcagcttcatattccccggctatctgcagatatgggaaatccggtgcgatcagtccttttgaaggggacgcttttttcacctcacagataaatgatagttcttcctttcccagcgcgcgttcaaagggaaatcctgtgtccgggcttaattgttccgcttcttttcgcaattgttccagaggaactgcctgtttccttatttttacccgttctcttgttttctcagctattgtatccagtatcatggtttactccatcctttaacatccattgtgattcagccgttcttttccatttatccaaaggcttagctgttggaacaggctataaactcttccagctttttcttcgccctgccgcttgaaatgatatcttcggccattctcactccggcttccatgctttctgcctttcctgcaatatagagcgcagctccggaattcaataccaccgcatctcttcttggccctttttctccttccagtatgctcagggtaatggcggcattttcttccggcgtaccgccctccagttcctttttatcgcattttacaaagccgaactgttccggttccaggtaataggttttgtaatccccgtcctttacctcacacacataggttttggcgctcatggagatttcatccagcttatccatgccgtaaaccaccatagccctttttactcccagattaaccagaacccttgccaaaggctctaccagagtctcatcatatacgcccatgacttccatattggctcctgccgggttagccagaggtcccaggatattaaagatggtacggattcccagttccctgcggacaggccccacatacctcatggccgtatggtatttctgggcaaataagaagcagataccgatatcccttaacagctcggcactcctggccggtgctattgtaatattcactcccagagcctccaggacatccgcagcgccgcatttgctggaggccgcccggtttccgtgctttgccaccgggacacctcccgccgcaattaccagcgccgaagtagtggaaatattaaaagaattggaacggtctccgccggttcccacgatttccagtacatccatgtcattcagaagacggacacaatgatttctcatttcctccgccgagcctgtgatttcctcaatggtttcccctttcatggaaagcgccgtcagatatgcgcttttctgaatatcagaagcttctccgctcatgatttcattcattacctctttcgccgtctcatatccgatatcttctctgtttgccagtctggcaattgcttccttaatcattttcaatccatcctttctgtcattcctttttttattccgctgcttctgaaagcagattacggataatatccattccttccggtgtcaatacggattccgggtgaaactgaactccatataccggatattccctgtgttccacagccatgatctcaccatccgctgttctcgccgtaataacaagttcttccggcatgctgtccggatccgctgccagcgaatggtatctggctacctgcatatgctctcccattccctgaaacagcctgctttccggctccagcagagcgtctgaagtctttccatgcatcagttcctttgcgtaacctattctggccccgaatgcttcgcatatggcctgatgccccagacataccccgaagatggggatttttcctgcaagcctgtgcaccacctcttcacagataccggcttccgacggttttccgggccccggcgaaagaacaatcagctccggctgcagcagttcaacggcatcgactgtcatttcatcattccgaatcaccttgatatccgggtttaccgtaccgatgagctggtacagattataggaaaagctgtcataattgtctattaacaaaatcacccgtcaattcctccttccgccgtctccagggccgtcctgaccgccctggccttattaatgcactcctgatattccttttccggttcgctgtccgccacgataccggccccggaacggataaagacctttccgtttttcgcaaatgccagccgtatggcaatgcaggtatccatgttccctgtgaaggccaggtagcctatggcaccgccgtaaattccccttttattgttttccagctcatttataatttcacaggcccgcagcttgggcgccccggaaagggttcctgccgggagaatggtctccacggcatccagcgcgtccctgttttcacccagtgtccccgaaaccgtggagccgatgtgcatcacatgagaatatcgttgtatggtcatgtatttttccacccttaccgttcctatcctgctgattttcccgatatcgtttcttcccaaatccaccagcatattatgctccgcacgttccttttcatcctccagcagctctttttccagtttttcatctccttccacagtggttcctctgggcctggttcccgcgagaggaaaggtatagagctgatctccctccagcttcaccaatgtttccggggaggctcctgctatttcaatgctgtcgctggaaaaatagaacatatagggggaaggatttattgtacgcagcagccggtaggtatcaaacaggcttccttccatatccgcctccagccggttggacagcaccacctggaaaatatccccttccctgatatggtgcttcgctttctccaccatgccgcagtattcctcacggctgaaaagctcccggaatccggatcgaagcttcagcggcgggatatccgcctttcgtccgttccgaatcaaatccgccatatacttcagttcttccatcgctttgttataggagcactccaaagcatccgttttcgcgttgacaaccagaattattttctgtctgtagttatcaaaggcaattactttgtcaaagagcatgagatccacatcctgaaagccttccgtatcctcggcatccagtttcagtgacggctcactgtatttcatgtaatcataggaaaaatatcctaccagcccgcctgtaaacgggggaagcccctccagcacagggcttttattctcttccagtatccgccgtatatattcccggggatttccttcatgctcctgggtatgaagcgtattttttattttcaccctaccgtcatgacaggtaatttccagcgccgggtcatatcccagaaaggtataacgtccccattgtttattatcctccgcactttccagcatataacaatggcggctgacattcttcagaatccgcatgacctctacgggtgtaaccgcatctgcatacagctccctggttaggggaatcagaccatatcgatccgccgatgctgcttttttcgcttgctccaggcttaatgtttccattttttcctccaattctctgcccggaccggttcacagaatattttccgcacaaaaaaacccgtccatgacagaattctgataaagtcttctgtcaaggacgggtaatatttcaccacccgcggtgccaccttgattcacgtaaaaataacgtgctctcgccggataccatcatatccgcggcaactgacgtatgcctcacgtcacggctaccggacagccctgcggcttcccttcaccatgccctccgtggtccatttaacaggctgcgttctgtccgttctcagcattccggactctctgtaagtgcacgatctgtttttatctccacatcatcggttttaaatatattgttttgttgtttgaagttttattttattgcattataacgctaaagttataaaaaggcaatagaaaatttaaaaaatgtggtggcatgtggtggaacagtatttgtactttcccctccgggtgtcctgtggccctgctcgctgcctgcctgtgcggcccgggagagatgttatttgctggttcagattcaaaaaagggatatttctaacagttgcgatatcccggtcagccgtcaacgcggctgaactcctccctttggtcgtcaaacatcgccgctaagtgcggacggctgatcgggatatcgcaactgtaagaaataatcacctttttttcatattcacctgcaaataacatctctcccgggccgcacaggcaggcagcgagcagggccacaggacacccggaggggaaagtacaaatactgttctgcgatatgttttgatagagtttagggcgtaatacgggctttggcaaagtgtatggggaggtggaagttgggggtggggttgtttatggggtggtaggcggcgtagtgttctatttcgggggattctgaaattttgtagaagttgcagtaaaattctgtggtttcgtccagttgggggaggccgcattcttttttcaggaaaggttccgggatcaggagggacagggtccagcggtcttggtgtatggtggttctgcagctgcaggttttcaggtattgccggggcatggaggatctgttttttcttccttttccgtaggcggcgtatagtgcggcgtttgcgtttatttcaaagttggtgtacatacaatcgttggtaaggggttctcctttttgggggaagacgagaaagatttccatggcgctgtctttgcatacggggtccatgtagttatggtattcttttttaggatttttttcttcgcaggtcatttccacataaaaacctttttctttcaggtaggtcattgtgccgtagactttgggttttgtcaggcaggtccacatatagttgtcgattgtaaataaggtgcctttatctgcgttttctggagaatcgatgatttttacctggtattccatgatttgcgttcctttctgaattggttgggccggggaggggctgtctgtcagtttctggcggacaggtttttccgggattttataaaaaaggccgtaatcccggaaggaaccggaggctacggccttttgatttgttacagggaatcagctttgaggatttctgctgtttcccgggctattgcaagttcttcgttggtgggaattacgagtactttggttccgtttccgggtttggaaatgactatttcttcgccgcgtttatggttggcctcttcatccagggaaattcccaggaatgaaaggctttcgcataccatgtcgcggataatggggctgttttctcctaatccggcggtaaagcagatagcgtccacgccgtccatttcggcggcataggctccgatatatttgataactctctgggaaaatgctttgagtgcgcggacggcatcggtgttgccttccaggtatgcatcttccaaatctctgaagtcggaggagaaaccatcggaaagtccgtaaacgccggattccttattgaggatgtccatgatttcatcgatgctctttccttctttacgtgcgataaacccaacaatggcgggatcgatatcgccgcttcttgtacccattatcaacccttccagaggggttaagcccatggaagtatctatgcatctgccattttttacagcggatacggacgctccgtttccgagatggcagacaatagttttcaggctttcatagggctgtccgaggacagctgccactcttttggaaacataatcatggcttgtcccgtggaatccatatctcctgattttgtagtccttatagtaatgatagggaattgcatacatatatgcttcttcaggcatggtctggtggaaggcagtatcaaacacgcctaccataggaattccgggcatcagggcttcacaggcttctataccgataatattggcagggttatggagaggagccagctcacagcattcctgaatggcctccttaacctcagcagtaatcagtgtggcttttgcgaaatgttcgcctccgtgcacaagccggtgtcctaccgctcctatttcctgaaggctcttcaccactcccgttttctcatcggtcagtgccttcagtaccaggctgacagcctctttatgatccttcatcggagcttctgtaacctgtttttcacctcctgcaggagtataaaccaaacggcttccttcaatcgctattctttcgcacagtccctttgcgatcagcttctcgctctgtgcatcaatcaactggaattttaaggaagaacttccgcagttaatgactaaaatattcataatcgtaataccttttcccttttcatatttacagctttttatacaagctgtgcctgtaccgccgtcaatgcaactacgcccacgatatcctcccaggagcatcctctggaaaggtcattaacaggtcttgcaataccctgaagcatcggaccgtaggcttccgctttaccgagacgctgtaccagtttgtagccgatatttcctgcatccaggttggggaatatcaggacatttgcttttccgccaacttcgctgtcaggagccttggatttggctaccttgggcaccagtgcggcatcggtctgcagttcgccgtcaagagtgagatgaggatattcttcatgagcgatttccactgcccttaccaccttgtccacaagaggatgatgtgcgcttccttttgtggaatgggaaagcatcgcaataataggctttgcaccgatcagctgtttaaagctcttagcgctggtgtccgcaatggcagccagttcttccgaagtgggatcctgattcagaccgcagtcagcaaaaaggaaggttccgtgctctccatactcacaatccggaacatccagaatgaagaaggcagaaaccagctttactcccggagcggtacgaaggatctgcagggaaggtcttaatacatcagccgtggcgtggcatgcaccggcaaccattccgtccgcatcattggcttttaccattacaactccgaaggtaagaggatcacttatcagaatttccttcgccttctctaccgtcattcccttggacttccttgtttcataaagaagctccacatattcatccaatttatctgttttcgtcggatctatcactgtcactccgttgagatccacttccagccagccggcgccgtccatgatcttctcttcattgccaaccataataatattggcaatcccctcctgcagcacatgagccgccgcaatcagtgtcctcttgtcgttagtttccggcagcacaatggtctttctgtccgctcttgctttctccttgatcgtgtcaatataagacatacccaaaaaactcctttctattccacttcttccaatttttgtcgttctttcatcgtctgaataaattatacagaattccttttttgtatacaaggccattttcctgaatttattgtacaaaatcctgcacattttataaatttgctaaaattgttcgtgaatttgtacaaaaagtggagtctgataaatttctgtcattgttcctttacccgaaacatgatattcttaccataaacaaaccgtaactgtccggagacgcgttcccaactggcggggatgggtttctggacagttacacctaacatttaaattgaactcggaaaggactctttacatgaaggttaccggaattattgcagaatataatccctttcacaaaggacatgcttatcatatacaaaaagcgaaagaacttaccggagccgattatctcatcgtagtgatgagcggcgattttactcagcgtggcatgcctgccattctggataaatacacccgggcgcgtatggcgcttgcctgcggggccgatctggtcctggaactgccggtccgcttcgcctgtgccagtgcggaattttttgccgggggagctgtttctctgttggatcggctgggagtggtggattctctttgcttcggaagtgaatgcggcaacgccggacggctgcagaaggcagcctctgtcctcgcagaggctgaagcctcggaaagcttcaggaacactctgcgggaaggtatacgcaatggcctctcttttcctgcggcacgggcgaaagcgttggaaacgcaagaaaatggaatcggtgagctttttacactccccaacaacatcctgggaatcgaatactgccgtgccctcctgcatctgaacagccctgtccggcctgtcaccgtcctccgtaagggcgccggctatcacgaagaggcgcttcatgatgagcaaaacgaagctcccggtttcagttccgctttcgctatccggcaggcactgcagcagagcggcagctttgacactgtccgcggttcactccctgaagaaacgctggaaatctgggaatattgccttaaaaatggcggaatcgtttcagagaaagatttttcccctctcctccgttaccggctgctgatggaagcggaaaacgggttttcttcctatgcggatgtcacacctgatttttctgaccgtctgaaaaagaacctggatcagtttaccggctggcacgatttctgccttctgcagaattccagggatatgacctataccagaatcagccgctgtctgtgccacatccttctcggactgtcacaggaaaagcaggaagaaagcaaacatatggcttttgcctcctcctatgcccgtcccctcggtttccgcagaagtgccgctccgctgctccaggctgttaaacagaattcctccattccttttctttccaaactggcagatgcccggcagctcctttctccctttgccgcaggcctgctggaggaagacataaaggcctcccatatttaccagaccgtagtcagcggcaaatatgaaaagccttttttgaatgaatacaggagacagattcctatcctgtaattgggttcagttcttaaagctgtgaattggagcgggaattcttccgcccctgtttacaaaggcttcgcagccaaaggaattgaccggcataatgggcgcatgccccagcaggcctccgaattccgcatggtctcccacctttttcccgataacaggaatcagccggaccgccgtcgtcttctgattcaccataccgattgccatttcatccgcaattataccggaaatggtggatgccttggtatctccgggaatggcgatcatgtccagacccacggaacagacgcaggtcatagcctccagtttttccagggtgagcgcaccggccatcaccgcatcaatcattccctgatcctcactcaccggtatgaatgcgccgcttaagccgcccacataggatgatgccataacgccgccctttttcacctgatcgttcagcagcgccagcgctgccgtcgttccgggcgctcccgcatgctccagccctatttcgcagagaatgtccgccacgctgtctccgatagccggagtcggcgcgagggaaagatcgacaataccgaagggaatccccagccttctggacgcttctctcgcaaccagctggcctactcttgttaccttaaatgccgttttcttgatcgtttcacagagaacctcaaagttttctccccgcactttttccaatgctgtttttactactcctggaccgcttacacccacattgatgatctgatccgcttccgtcacgccatggaaggctcccgccataaagggattatcatcgggcgcgttacagaacaccacaagcttggtacatccggaagaatccgtttccttcgtatactctgcggcttccagaatgatttctcccatcagcctgacggcatccatattgattcccgtcttggtcgaacccaggtttacggagctgcagactctttctgttctggcaagagccatgggaatcgagcggattaaaagctcctccgcaggagtcattcccttggataccaaggcggaatagccgccgataaaatttactcccacttccttggccgctttatccagcgtgtccgcaatgacggcaaaatcctccggagttttacaggccgcccctccaatcagggcgatgggggtaacggaaattcttttatttacaataggaatcccatattctctggaaatttcttcgcccacctgaaccagattgctggccgcccgggtgattttctgatatatcttttcatttactctgtcaagatccgaatcaatacaatccagaaggctgatacccagggttatggtccgcacatccagattttccttctcgatcatcttattcgtttcatttacttcaaatatattaatcatacctaaacctcttccactcctgtatgtagaaccgcccgccagggatccccaaagccttcagcccggccggcaaaatcattacggcctgcaaagatatcagagcctgtgcatctggttaaagatttcttcgctctggcatttgataataacaccgatttcttctcccagccgggtaagttcatccgtgatatcaccaaaaggttttccggtatggttcatgtccacaatcatcatcatattgaaatagccctgtacaatagtctggctgatatccaggatattaatattgttttccgcaagatacgtacacactctggctataattccaaccgtatcatgtcctactaccgttataatagtttttttcatatgctttcctccaattttccttatgcgatttcgatcaaacgggaaacctcgcttctttttgccacctgaatcgggaaatcccccgctttatattgggtatccgactgggtaatctccagctttaccgtctcataggccagctccggcaggttgttttctttgctcagatgccccagcacaatatactgaagcttatcatgaagcagccggcttaacaatcttcctgaattttcattggaaagatgtccccggtctcccagtatccgctgttttaaagggtaaggataaggccctacctgaagcatgttcacatcatgattcgcttccagaaggagggcatccatccctctcagtgattctatcgtataatcattgtatgtgcccagatccgttatcacaccgattttctgttttccgtaagagaatcggtaagccaccggctccgccgcatcatgggaaatccgcatgggattaaccgtcatatcctttatggtaaagctttcatccgcttttaccgtctggaacagaccgtcatctatcgctccgaggcttctgcatccccggatggcatccagagttttaggagtcgcatatatgggaacgttgtatttgcgggaaaacacgcccagaccactgatgtggtcactatgttcatgagtcacgaaaatcgcatccagctcaccgggacatattcccaggctgttgagcccttcctccgtcctctttctgctgattcccacatccaccagaacatgtgtggtatccgtccctacataaatgcagtttccgctgctgccgctggcaatgctgcacagtctcataatctttttaactccttatctttcgccctgtccattttatatccatgtactaatatgccatatccggatcattcttgcaagggaaaaaagccatccatgtaaaatcaggctttcttaagcgcattttccagctgcgcataggtttcctgcaaatctccgttattttcaatgaccctgacgcagttcctgcggaattcttcctcagacagctggctggcaaaaatccggtcaatcttttcatccgtatagtttctgctttccttaagacgcctgcgcctgatatccgcatcggcatggatataccagagttcgtccgcaacttttccatatccctcttcaatcagcagcgccgcttccagaaaaaagaatgcaatacgtcccgcttttctttccttatccacttcctgtaatatgtatactttcaccgcaggatggatgatcgcgttcacttttgcgagcagttccctgtccgcaaaaattatggcagccattttccccttgtctatcctgccctccgcgtccagaacttcttcacctaacaattccacaagctgcccgtaacattcttgtccgggcagcttcacttcatttgccacatcatccgccagcaggatacggcagctgcagtgagaagccagataggaaagcacctgggtctttcccgctcctacgccgccggtaataccaatcagcttcatcttaaatccgctcctcttattttgcttcgtaccagtttttccccgtatgaagatcaatttccagagataccgccagatccgcagcgtttttcatttctttttccattatggcggcaacctgttccagctcatcctgcgccgtttccaccaacaattcatcatggatctggagaatcagtctggacttcagattttcctctttcagccgcttccatacacgtatcatggcaattttaatgatgtccgccgcagttccctgtatcggggcattcatagccactctctccccgaaggaacgctgcataaaattactggacttcagttcaggcaccggtcttcttcttccgaacatggtaatggaatagccattctccttcgctttctccacttcttcgtccaggaattctttcaccttaggataggttttaaaatactcctctatatactgggatgcctcttttctggaaatgctcaaatcctggcttaaaccgaaagaactgatcccatatacgattccgaaattaaccgccttggcattccttctctgaagatccgtcacctgctcaaaaggcgtgtggaacaccttggatgccgtaattctgtggatatctgcatcggaacggtatgcttcaatcagctgttcatcccctgacatatgggcgagaacacgcagctctatctgagaataatccgcatcggtaaacagatagccttccttcggcacaaaaaccttccggataagccttcccagctccatacgcatgggaatattctgaaggttcggctctgtggagctgattcttcctgttgccgtaattgtctggttcagtgtggtatgaatccggttattttctccgatatataccgccaggccgtcggcataggtagatttcagcttcgccagtcctctgtattccaatatctccgatacaatggggaattccggcgccagcttttccagaacatccgccgctgtggaatagcctgtctttgttttcttccctccgggaagcttcattttctcaaaaaggacttctcccagctgcttcggcgaattgatattaaaatcttctccggcctgcttatgaatggaattctccagctcattgattcggtctaccaacgcatccccgtaggccttcaattcctccgggcgtacttccaccccttctttttccatttcatgaaggaccctggtcagaggcatctctatctcacggaacagattttccatctctgtttcctgtaatttttcctgaaggagcggctgtgcaaggaaaatggtataaacggcaaaacccgcatattcctgaaatgcctcttccttttcctgtgccgccttcgtcagagaaagcttctccagaagctgctgacggctctggatcataagccccagctgctcattggctatatcctcgatgctgtaatcatttttcaacggattcagcagataagcggcaatcagtacatcaaaaaactgccctgtctcatcctggttcagatatgcatactgcggcttgatctgaaaggtcgaaagtttggtccctttatcggccagttcggccagcttccctgtcaggtattctttggtcaggaagccctggggccgtaaaatccatatcttatccggtgccgccgccaaagccagcgctgcgaaatcctcatctttactactgtcctccagtaccagaaatgccgctctctccgccttacccgcttccgcaaatgcagtttcagcttccgtgagatcggatgtcatgaagaaagaatccttctggctgttttgggtaaccgcctcctcttcaaaacgcccgagcagatttttaaattccagctgtttaaacagcgtatatgcctccggtgtaaataagtcctgcatgctcaccatgtcccaggttacatccagatcacaatctgtatggatcgttgcaaggaccttgctcagatccgccagatccttgttttcagcaagagattcgcggatactttttttgcttatatcatccagatgagcatatatattatccagggaaccgtactgtaccatgagttccgtcgcagtcttgggccctaccttgggaacccccggaatattatcggaagaatcgcccatcagcgccttcagttcaataaactgtaccggagttacctgatacgcgtcctccacatcttttgcataataatcctcgatttccgtctttccgcccttggttttgggaatccggatttttatatggtcactggcaatctgaagaagatccctgtcacccgataccagggcaacctccatcccatccttttcccccttcttcgccagggttcccaggatatcatccgcctcaagacctgccttttccacagtacaaactcccatagccttcagcacttccttaataacaggcacctgctcccgcagctcctcgggcatgggctttcttgtccccttatactccttataaagctcatgccggaatgtaggcgcatgtacatcaaatgccaccgccaggaattcaggcttttcttcctccagtattttaaacataatattcaggaagccatataccgcattggtatgaagcccctgcgcattactcaaatcaggcacaccatagaacgctctgttcagtatgctgtgcccgtcaatcagaaccatctttttactcatataaataccaccgttgtcataaccagaatcactatcagcatggcgatcacttcaaaataatataatccccgctgcagtctctggcgtatttttacatggctttccgccatttgaagtcttgcggacagttcatcatttaaattaaaagcatccccgtcctccagacgttccattcccaccgtaaccaggaactgaatactgagctcctctttacaggatggacacttcttcacatgctccaggaactgctttgccgccctggtttccatttctcccttaataaaatcaggtatcagtttttcagcctgcttacaatccatccggacggcctccttcctttgcgcatatcatccatgtggaaaggaaacctatatatagtttcctccgctcttatattaatatatactaaaattaccagatataaaagatttttcttaaaaagacaaaaaaataagagagtaacctcagaaaataaagtattcctctcttatgtaatataaatacagcaaaaacagtactatgcaaaactgtttattttatctttcatacggcgcatttcattttctaatgtattaacacggataataagcatttctttttcattttccacttttaatgcctcgtcaagcttgcgtgaaagatccagatgcccttcggcaactcttcttatattggggcctgtttcattttccagtgtcaaacgaatatcagtcacgccattttccaacttcataagacgattatccagctgtgtaaaccgttcatccatagcccccatttgcttcagcaataaatcaagtttttcagaatctgtcataagctatacctcctatatgcatatagtaacataatcaaaagataaagtctattccgttattactatccattcagaacacaattacagttcagacaggcctgaaccgttaaacatacagccaataaaatcatagcgcaataggccggatgccgtacataaaagcacggcatccgtatgatttacagacttgttatctgttacagcatcttcttccctctgcagtaggtctgaaccacatcgtagttgtcttccaacaccacaatatccgcatcgtatcctaccaccagttttccctttcggtcatccactccgagacatctggcagggttgagcgtacaagaattaatggcagcatccagaggaaccagggctttttccaccagaatcttaagtcccttattcatattcaatgtacttcctgcaattgtatcggtccccttcagtctggcgagtccgtcttccccaatttcaatatcatggcctcccagctgatagctgccgcccggagggcagtgctttgcacggagcgaatcacttaccataattccataatccctgcccttggcctggaaatagttatttaatgccgccagatgggaatgacagccatcgcagatgatttcaccgtaaatatcccttacacggaaagcagcacccacaagtcccggctttctgtgatgataaggtgtcattccgttataaacatgggtcatgctggtcgcaccattggcaatacccagcatagcctgctcataagtcgcagaggaatgccccatactcactacaacaccggtttcccggcagtgtctggtaagggcaaaattcctgtcatgttcaggggccatggtaatatatttgatcaggccttccgccgcttcctggtacattttaaactgctctacagccgcggtggcaatagcctcaggaggctgcgcccccttatattccatgtccagataagggccttcaaaatgaacacccaggatttctgcgccttcatagccttccttaaccacggccgcaacatttctcaacgcttcggtcaggacctccggcatctgcgttaccgtagtggggaggatagctgttacaccctcttcaggaatacgtttcatccagtcacgcagtccttccggttcggcgtcattcgtatcaaaaccataagctccatgggtatgcacatctataaaaccgggaaggatacgcttttcgccataatcctcatccgcttcttttgtaccataaggaaggatgtccgttatttttccgtcatttacttccagctgcatggcgagaaactgtccggctatccatacctgcttgctttgtattatcatatcattatcctcctagaatgctttattccagccacataagtaaggaatgttctgtcagattccggaaagcgccgcctcatctgcaactacaaccacatcattatgaagctggagaaccgatgcaggaacctgaggcgttaccggtccgaaaaatgccttcttaacgatctcagccttatcttccccgcttacaaccacaagaacctttttagcctgcataatcgttttaatccccatagtatatgcctgtttgggaacttcatcataggaagcgaagaaacgctggtttgccttaatggtagactctgtcaaatccacacaatgggtttccagttcgaagctgtcagcgggttcattaaagccgatatgtccgttatggcccaggccaagaagctgaagatcaattcctcccacagacgcgatcaccttattgtaatcatcacatgccttcgcgctgtccggctccgttccgtcaggaagatgggttctttccttattaatatttacatgtttaaaaagattgtcattcataaaataatagtagctctggtcattatctctggtcagccccttgtattcatccagattaacagaggtaacctcggagaagtccagatcccctttattgtaccattccacaagctgcttataggtcccgacaggcgtggaaccggtagcaagccccagtacacaatccggcttgataataacctgtgcggaaataatatttgccgctttcctgctcatgtccatataatccttagctttaataattttcatttttactgctccttctcaatgtatttagtatatacgtttcccttatattataaactattatacagccagtctccagactgttctatgtacaatccggtctttttttaaccatatttgtccaaaaagtctttataaccaaattcggaagctcctgttacggagcttccgactgtgctaggcaggaaaatttgggttctgtatgcttttattaaagcattttcttcatttcatccgctacgaactgaaccttggttcctacaattacctgaacggatgtcttgctgggtctgataatacccgcaacaccggctgatttgattttcttctcatctaccttggtgtaatcattgatttcgaaacgaagtctggtaatacagttatccagagacttcacgttttctttaccgccaattccttcaagaacaaccttggcaactgctgtaaagtcgttgtttgacagaaccacgctcttttcggcttccagatcatcatcttcacggccaggtgtcttaaggttgaatttggtaataacaaaacggaagattacatagtacaggatacctactacgatacctatcggaagcactaaccagggattctcggctaaaggcgtaaaggaactcaatacaaggtcaatggcgccgccggagaaggagaaacctgctctgacaggaagtgctacggtaatacctgcagtaataccggctaataatgcatgaacgagatacagcccgggagccaggaacatgaaagagaattcgataggctctgttacaccggtgaagaaagaacagaatgctgcggatgcaagcagaccataaactactttcttcttattggatttagctgtatgatacatcgccagacaggcagcaggaagaccaaacatcatgaacgggaagaatcctgtcatgtacataccagtctgtccgtaagtacctgtatttccccagaagtttccgaggtcattaattcctgcaacgtcgaaccagaatacggagttcaatgcatgatgcagaccgaaaggaatcagcagacggttgaagaatgcataaatacctgcacctacagcgcccattcccaggaagctttctcccagtttaaccaaaccgccaaacagcagaggccatataaagaacaatattgcggaagcaaggatagagaacatagctgttacaattgcaaccgcacgcttgccgctgaagaaagaaagtgcatcgggaagcttggttcctttgaatttattatagcatgttgcaccaatcagaccggccaggataccgacaaactggttattgattttggcgaatgcaggatctgcatccgcaccggtcagacctgctactgtgccggagctgagcagtgtggtaatcatcaggaaagataccagacctgccagacctgcggtaccgtcattatcatcagacataccaacagcgacaccaatggcaaaaagccatgccatattatcaatcagagcaccaccggctttaatcaggaataaaccgatagtataggcaacaccgcctgctgtaaagcccgcaacctcaccagccatagcggcaggtgccaaaatgtacccaacgcccatcaggataccgcaaaccggcagacaagcaaccggcagcatcaaggacttacctaatctttgcaaatacttcatcataattaaaattgcccccttctttttctgttctgccctagctacagaactttttctttattcaaaaggaattctctttcctttagaatacaacttgtttacaggttctctttcatgaaggcttccagcgcctgtgccgcagcatcttcatccggtccttctatagtaaaagtaacagtctggccctgtttcacggccatcatcatcagggacataattttctttgcgtcccccttcttggttccgttatccacggaaactgtgctggcaaattctgcagccttctttaccagaagacccgcaggccttgcatggattcccagctcgtcagtgatcgtatacttaaattctttcatgtacgtctgtctcccttcttcatatttttatcaaaaccactatccgttattatggaattgtggcagatacctttttcagcagttcttcaggcctatatatcccttaccgcttttctcacactcaatacataggtgggagacacggaaagctcatctactcccatatcaacaaaagtctttgtcagtgtggtatccccgccaagctcgccgcagatgcctacccagattcccgctttatgaccattttccactgtcatccggataagccggagaactgcctcatggtgggaatcataaaaatcatcaagattctgattctgcctgtctatagccagcgtgtactgagtcaggtcatttgttccaatactgaaaaattcaacttccttcgccagttcatcactgataactgctgccgccggtgtttcaatcatgattcccagttccactcggttgaagctgattccttctttggtaagctcctcttttacttcctccacaattttctttattttcctgatttctcctacggaaataatcatggggaacataatagccgccgtaccgaaggcagaagccctgtaaatagctctcagctgtgttttgaaaacctcaggtctttccaggcagatacggatagcgcgaaagcccatcgccggattttcttccttgggaagtttaaaataatccacctgtttgtcggccccgatatccagggttctgataattaccttcttgccttccatctttgaaaggacttccttatatatatggaactgctcttcctctgaaggataatcttctcttcccagataaataaattcactgcggaaaagtccgattccgccggcatcggattccagtaccttatccacatctgatacatttccgatattggcatacaagttaattctgcgtccgtcagaggtaatgttgtctttaccttttaattcctgaagagccgtacgttctttttcatattccatctttttctgtaccatcgtatccagcaccgaatcctccggattgatgataaaggtaccgctgaatccatccaccacggccttagcgccgctgtactcttccaaaagggctacatccgtctgtacaagagccggaatgttcatggacctggccagaattgccgtatgggaattcgttgaaccatgcttggttacaatcgcaagtattttgcttttatccatctgcacagtctcactgggggaaaggtcgtctgccagcagtatcaccggttcttccgatacaattccctcttcgcctactcctgcgagtatccgtatcagacgtttggaaatatccaggacatctgcagaacgggctttcatatactcgtcatccatacttgcgaaaacacctgcgaaattatctccggtaaggctcacggcatactccgcattcattttttcatcccggatcatcccgcggatagagtccagataatcttcgtcttccaacatcatcttatggacatcaaagatcatcgcctgctcttctccggcttccaccaatgctttctgatacagctcctccagctggcttccggcggcctcttttgccttttccagtctttccacttctgcctcgggattttccgcagtttcctgcttcagaacatattcctgctttttgtacaaatatattcttcctattgcaatcccttttaatacgcttttaccggaacatttaatcatggttattcctcccagctatttacttggtaatttccagacaatcgtcaccaggcttaaccatcttcccggtttttccctcgacagaagcataatctgacgtattgcatacaatcatgggggtaatgacatcatatccggcggccttaatctgttcgatatccgcttctaacagcaaatcccctttgcttactttggctcccgtctccgtatggattgtaaaatgctgtccgctaagcttaaccgtatccagcccgatgtgaatcaggatttccacaccctccgccgtagtgagtcccaatgcatggcctgtgggaaatacagtggttatctcgcagtctgcaggtgcatatacctttccgttaacaggcactactgcgattcccttaccgagtatttcctcactgaaggtagggtcatttacctgcttcagggaaacacattctccttccagaggtgatccgagaacaattccttttttcttaaaaacatcaaataagcccattttcatccatcccttctttttgactgatcattttttgttattctgtgtcatatctgtaaagctgccggcctgcttcagctgcagggccagataaatctgctcttccccggtcatttcacagccgtactgctctttcacatgttcttttacctttcctgccagcgcgtattccccgctgcagtggttcttcacaaactcttcaaatacgtaatcctctcttccttccacaggaggaagcagaagcatccggtgagcgaggaatttaaggttggatgccagcctatccctgtaaagggaatcctccggcggcagattgaggcttttctccagtatctgcatcatatcctgtatcatattagtcatagcccatgtatcccggaccttaatatcaaattcggcatctacaagatgaatggctatggaagccgcttcatcgtccggcaggcgtatcccggtcctttcttctataaggctgagggcatgcattccgattccgaactcctgaggataaaaccgtttgatttcacggtaaagggcattggaaaaatccattccgtctttaaaacgttctattgcaaaaccaatatggtcggtgagtgtcaaatatacattctggctgagctttgtattcagattttttcttgcatatgaaataatatccgccgatacctgaatatattctaacggcatgcttgcgagcaaatctttaaagcgttcccgcacatccttactttccagccggaatatcttttctatgccatcctccgctacatcctgcccggctttcttctgaaaacccaggccgcggcccataacaattatttccttaccctcctcatcccaggaggacaccacattattattaattatttttccgattatcatacctgacctctgctgtggagattggaagtataattctggtttccggtttgttttacgctgttagcattcccaaaatatatttcagaatgtaatttatgaataaaaaaaaccaaatcttataagttaacctcaccagcctgtactcacacaacatacatacggcgattaacttataaaatctggttttgcctgcctgacagtaacaacccactcagtatttatctctttccctcatctgaattgagcatatcaaacttgccaattgatgtcaagagtgaataggtaatttcgtgtctttttcacatatttaacgtttgatttttatgcacatcgtctatatcccatactttttcaaatattcatttttcttgtttatatatataatatctaattttattcttttccgcgctaacactttcatgtgacagagaatttaatcttaagaaatttttccgcctattccttatgaatcatgttataataacaggcatagacttatattaaccataatcaggtaggagttctcatgaaaaaaagaaaatcatccggtaattttatcggcataggcttactgtgcctgctgtttttatgtgtagctgttttcagtattttctttgtctgctgcagcaagccgtcctccgactcgtctgaggaaactattccccccgaaactttttccgaaacgggcggcatatctgacaataccgcagctcagacggaaagctctgtacctccgttcgaagaagcttccacggaacagaaggaagcgcggaatttgaccggattgaaactgtccattcttggggacagcatttccacatttgatggttatatcccgactgactataatatcttttatcctaactacggagatatttccacagtagaaaaaacctggtggtttcaggttctctcttctacaggaatggagctaaatgccaatgcttcttcttccaacaccgacgtttcgggtgattcttcagatactaccggcagcgctcccggatgcagtttcaaacggattaatgatttaacccccggtgacgatggccccgctcctgatatccttattgtatttatgggcgtaaatgacttcttgcggagtgtggagctgggtaattttaccactcctgaggcacagcaggaaggggttattaccaatttctgcgatgcctatgagttgatgctgcagaagcttgcggcaacttatcccaagacacagatttatttctgtacccttttggaaaccaatgcaggggatgttgacgacaatcccggagccttcccttccaccaatgaaaacgggaacacaatagctgatttcaacgcggaaatcgccacaatcgcttccgcctataattatccggtaattgacgtccataattgcggtattacctatgataatctttcggattataccattgacggcacccaccccaatgcggagggcgcacaccttatcgcggaatatattaccaaatcacttttatattagttacaataacagacataacttgacaaactccttttctctgtgctaccttttttattggataacaattgagaaaaggagttttttatgctatgaaaaaaggagtaaaattcacagccctggccctggcagcttcccttatgttcacttacccgctgtgcaatggcataaccgcagatgccgccgctccgctgaaaacagtggaatcttccaatgttcctacgaaatacacaggtatgagcctttccattctgggggacagcctctcaacctttaatgactatattcccagagattataatattttctatcctggaaacagcggtattcccatggtagaagggacctggtggtatcaggtgctgaacgccacaggtatgcgcctgtgcagcaacgcttcttccgccaataccaatgtaaccgggaattcccttgccacggacggctccgcacctggctgcagcttccgtcgtattatggatttaaagggtgctgacggcacgtctcccaatgtcatcgtaatttatatgggagtaaacgattttgcccgggatataccgttaggctcctttaaggcaccttctcttcaaaccgaaggaacacctgccaccttcagcagcgcttacgaactgatgcttctgaaaataaagactctgtatcccgatgccgccgtatactgctgtaccctttttgccagagatccggggctcagagcgccgggaaccaatactcccgtgaacaggaatggtgattctatcatggacttcaataagcaaatccgtgctattgccgccgcatacggcgcatccgtcatcgatgtttataattgcggaattacatatgataatctttctgtttttactagtgacggcgtacaccccaatcttccgggcgcacagctgtttgccaattgtgtaacagcagcattagttaattcctgacagccgatttcgatacagaagaaaaaaggctccggtataaaagcaatgtctaagcttaacgacattcttttgataccggagtcttttattcgtttcttattgccgcaagaggactcagtctcatcgctctgagcgaagggaaaaatcccgctatcattcccacaagaatggcaaagaccaaagacaggagcgccagccatggaggtatataggacaacgtcatcatattccccatagatgccacgatctggtttatcagtatcgatatggcaaagctgaataccagccccacaataccaccgataaaaccgatgaatcctgcttccatcaaaaacatcatctgaatatttctcaggtcacagccaagaactttcataataccgatttctttcgtacgttcataaatggacatcatcatcgtatttgtgattccgatagccgctaccagcagtgaaaccgctccgattccccccagtaccagctgcacatatccgtactgtgtctgcatggcctgcacccattccgcgttgctggaggcctggtatcccatggcattgatggcattctgcacctctgtaacgttttccatgtcatccacatctacatatatctgactgtaatatatttccttgaagggcttacccgtttttgtagtcggctgtccgggaatggctttatttttaaatatacgctttaattccgtcttcagcaaatcaatatcacaataaacatcatagctgtatctgctccagttttcgggaccgccctctaccagaccgcaggtaccaatgagatactttttgggaggaggcgtcttggaagctcccgaactgccgtctccatatttattactgtaataagcgcttgtgtcgaaaataacgaaaacagggtccttcagaagattaacatccggcatttctcccttctcataatacggatagctgccggttctcgcattataaaaactctgtaaaaccatatttccataaaagaattccagcttttccgcatttttctgaggaaaggtgccttcccccaaagggattttcatagcctcaaaagcctccggggtcattccctggactctgaaattgccttcataaatcccgcttctggcaatgacatccacactgagcaccggcgacacaagattcacgtgcgggatggccttcagtgtttccaccagctcatcgtccagccttttttcctcctgctctttatcggaagaagagctttgcaccataacgctgccggaataagaatagccataacctccggcttcgttaaccgttatcgcggtaaggctgccgtaggattccatttcttccatggatgacttattcagccccaaccccagggaaaccattactacaatagaagccacgccaatggtcactcccagcacggtaagcagggtacgcacttttctcttccacaggctgctgctgcttaaccgcagcaaatccaaaaatttcatatccgctcctgcccctggttattcttcattgtctgtgtccagcagctcttcttccagtttcagggccgccgccttctttttcttttttctgactgtcacaatgacaattatgactgctgccacaaccaccgccgccgcaatacctataattaaaccgatattaacgccgccctggttatccacgggaatatcctccggcattgagggatccatataaacctcttcatagacatccagcgcaaaattcctctcaaagctcaccaattcccctgattcattttcaaaggatattttagctttgattgttccgtcacccgtactgggggcaaccgcagtaatcatggaatccacgcttcctgtttctcccggtttcagagttccgaggaaggtatctcctccttcaatggaatccccctcatatttcacctgaagattataaaaagtggttttaccggtattatatatgctgaacatgacattagactgactgcctatggaaatgctggcaggcattgcctcaatatcaccggtatcatacttagcctcctgcagcaccggaacggatacctttgcctcatcagtaaggtcgacatcttttcctgaatcatatttcatttttacggttattacataaggcttctgtgtcagatccgtcttggcggtcatttcaatattaatatcaaattcactgccgggtccgatggaatccgtgtaaacagaactggaacccgaagtaggcaggaatacagcataggtggtattggcctccgtaccgctttccaccgcctgcatgtcaaacagcacattattaaccgctttttctttggaggtattcttcacatggatagttaccataaaggtatcgccggcataaatttccttgggatttgtctcaaagccggttacaatgatacgcggtttggactccacggctccgtcatcgccgccgatatgccctgctccgggttttccctgtgtatatacataaaccgatacagtctccggctcttcacaccttacccccgcctttgtataccagatttcaaaagacagcgggtaatagccggtcattacatcatctctcaccgtaaaattataagtcagctctcttctggcgaacataccggcctcataattacctccatagggatttcccggtatttccgcaaaagactgaacatatcccgtagcatccggttcaaaaggccatagcttgacatcattggaaacgacaggcttcaccaccagatcggtaagattctcacttcccagatttataataggcagaacaatggaaacctgctgcccgtagctgacagacggcgtctcccagttatttcccacctgaagaaattccgttgtaggtttcgttaccgatgtgtccggaactaccgcatccagcttggccttcatctcgcctacgtaagaccataattcaccaacactcatctctgtgttggcaatataatatatggcactgtataaagtgtcattcagcttcttaagcgtatattcatccggatgtgtccgcttcagtatactgtccacatgcgccttcagctgggcgtcggcatccgcacgatcgtcatcagtaattacattcggcgaggagcggtcgatcgtgttgccgctggtagaagaggccattacccgtcctgcattcccctgaaaaggtaccgctgcaagcagcgctatgcatactaatgtcaaactgatggtgctgatgattttttttcctgcgttcattttcttcccctttgtacttctctaagcattctcttgtattttctgccggttgtcttctattttaacgattttgccatcgattatatggaagatacgatcggcgaaactcgccagataattatcatgggtaaccatgaccagcgtctgcttctgttcccttaccaccttctgcatcaattccataacctccttcgaggtattggaatccagattgccggtaggttcatcggcaaagattatttccgggttcaccacaagggctctggccacgcccactctctgctgctggccgccggacatctgtgtcggcttatgcttcttatgctccttcagcccgaccagatccaggactctggaagcccgcttcaaacgaatatccttatccactccctgaaaggttaagggaagcgccacattctccaccgcattcatggttcccatcaggttaaaggactggaaaataaaaccgatatgctctctgcggaatttaaccagctggttttccgtcttattctccatatgttctcccgcaataattatttcacccttggtaggtttctccaaccccgccagcatattcagaagagtcgattttcctgaaccggaggtacccacaatcgaacagaactcccctttatatatttcaaggttcactccgtcaagcgcgcgtacgtggctgtcgccaacacgatatactttatataaattcttaacctgaatgaccggcttcgcttccgttcccatgcaatcctctcaatctgccaaaaaagtacattttttcaaattctttcttcgacattatatcatactccattagtttttcctatttaagatttttttaatattcataaacacttttgtatttttttacctgataaagcgccagaatcaatgtagcgcattctgccgccggtaccgcaagccagaggccatttatctcccacagccaggaaaataacaaaatacctgtaacagtaaacccaaacgtacggaccatggatatcattgccgaaatctttccgttggacaaagccgtaaacagagaagaaacgaaaatattcattccggcgaacagataattgacggagtataataaatatccctgataggtcagttcgttggcggaggtccctccgggaaggaaaagtcccaccaaaggtttagccagaagtatggatgctcctgtcataagaaaagagcataatatcatacttttcatacatattcgaaatacggtctgcagctgtttcttattcctgctgccgtaattatagctgatgaccggggcaaccccattggaaaagcccagaaacactgcggtaaaaaagaactgcgtatacagaaccaccgttaccgcggccactccgtcttctcctgcaaaatgcatcatcagaagattcatcagccaggtaataacgctggccgcaagattactcaccatttccgaagaaccgttcagacagctttcccacagcacttcaccctggaaagaagcttttaccaggaaaagctccgttctgggctttaaaaaataaaaaaaggcataaacaggcattatggaatatccaaccgccgttgccagggccgctccgccgattccccagtccaaaaccgcaataaatatataatccaatatcatattagccaatcctgacaatatggtaagccccaatcccagattaggcttccctgcggtaacaaaaaggaccccaagaatcgtctgcagcatctgtaccgccatgaagggaagaagtattatcatatattccctgcagtaccccatcaatctttcactggatcccagaagtttcagcagcggctccagaaaaaccatgctgacaatggtaaaaaggattccaagaatcagcccgaatacaagaatccttgtgaagttctttctcgcctcctgtgcctgccccaggccaagctgtcttgctatgactgcacttccgccggttcccagcatgattcccatgccgactaccaggccgatcaacggataaactatattgatggcagaaagggcatccgctcccacaaaacgggacacaaagaacccatccaccatggtatacattgacatgaataccatcattattatcgttggaaatgcaaatttcagcaaagtccttccattaaaattctgtgaaatagaatggctcatattccgtcctcctgctgttcatcatttacaaagcttgcaagccccgcaaaagcctactataatgtatggagtaaccctatagtcaacacttttttatccatcttttagacggcggccctgttccggaaaatatcctgagccgcctgttttggaggaagcatgaataacaattcgaaaccgctgtttaccacaggagaatttgcaaggctctgcaatatacgaaaagacactcttttctattatgatgaaatagacctgctgaaacctgaaatcatacaggataatggctaccgttattattccgtcaatcagctttttttatttgatatcattgccatgctgaaagaatgcggcacacccttaaaagaaataaaagaatatctcactgcccgagaaccggcatcctttctgacccttatggaagaaaatgataaaatcctttatgcggaaatggaacggctgatgcatatccaccgcctgatgcgcaataccatcgagcttacgaaacatgctctcaagacagaatacaacgtcccgttccttcaggaatgcccggaagaatattttatagccatgcccttttccaccgaatatgaggactatgaaagaaatcagtccgaaacaattaaggcactgctggaatatctggaaaccaatctcctgggtgaagaatatcccttaggctccattattttaaaagagaatctctgttacgatgaatataaggaggactattactgcagcaaactctcctctcccatacaaaatcccctgctttttgtaaaaccggcaggaacctatgccatgctcactcataaaggttcttatgagaccctcagccagtcttataacatcctcaaggattacatcaaaaagtccggccttcagataaccggcaattcctatgagcatgaattgcttaattatctggcaaccggacgatccgaaaactatgtgattgaaatttccattcagacgggctgaactaatggtacaggaaaaaacctgccgccccggtgagaagcattaacgcaacagggcccaatccctttaccttcccctttgtaaaaagaggaacgataatccttggaagcagcagcgcggatacaaagagcgccacactgcgtatctctataccgctcagggataactgtccgatatcggagcttccccaaaaagtaagaagcaggatggttcctgctgcggaaagaatcaatcccgtggacgccgccttcagccccctcagaagatgcgtcatatagaaggagtttcctttcttcttaaaaaatacatacaacagcagtgacagcacaatccctccggccacacagcctgcggtagcagccgctgccccccatactcccgccagctggaatccggcaaaagtagaagcatttacagccagcggccccggagtcatctgtgaaatcgtaataatatccccgaaagttttctctgtcagccatccgtattttcccacaatctgattctgaatcagactgatcactgcatagcctcccccaatgctgaagcatccaatctgaagaaacactccgaaaagttttgcaatcagttccattacacttcctcactctctttctctgtcttcttcaccctcctgccgcacagataccatgcctgggccagactcataatacaccctgtcaccagagccagggccgcacttccttttcccaggaaacaaaagataaatattccgggtatcatgagggaaaacaggaaattatgttccttccaaatatttctgcacattccgaatgcggtttccgcaatcaataccgctgctccagcctgcattccctttaaaacagccgccattgcatgattggcaataaacgcctgatagctgtgggagatcactcccattatcagaaacggagggaacacagatgcaaatgcactgataatcgcccctgacgccccagccacccggaatcctgtgaccgccgccagattcacggcaatggctcccggcgctgattgagataccgccgccatttccgccagttcttcctctccaaacatcttcttttgcaggacaaaatattttcttatcatgggaactaccacataccctcccccgaaagtaaacgcgctgataaacatatgtatgcccagcagccataaataaagcctttttttaccttttttcataaatgctgcctcctcgtccgccttattatatagcttgctttatcattagtaaaatgatatattttaatcaatctcattacttttattcatctataatcaaggagcgattattatgacaatacggcatatggaaattctgaaagcgatatccgaaacaggcagttttacaaaagccgcacggctactgtatattacgcagtccgcggtatctcatgccgttcaggaactggaaacggaagcggggacacttctttttgaccgtctctccaagacaatcagacttacggaagccggaaacctccttctgcaggaaattcttcccctcctggattcctgcaaggcagtagagtccaaaataaaacagctggaccgacgcgcccctatccgcattgtgtccagcattactattgcctcttactatctgcccgatgctcttcatcggtttgaagcttctcacccggatattccggtatatgtaaatgtggtaagcgcagctaatgccatagaggtacttcaggcaggaaatgctgatatcgccctggtagaaggccttcctcccaacggcccttatcaaagtacccccttttcctcttatccgctactgaccctttgctcacccgattatccacattcccggcagccgctgtctccctccgctctgacagaagaacggcttcttctgagagaaaaaggaagcgctatccgtgatgtactggacagcgctctctatctttatggttttaccgctcatcctctttggacaagcgtcaattctcctgcgctcatcgaagccgctaaagccggcctgggaattaccatattgccggatattctggtaaaagatgctctgaacgaagggagcctgatttctctggaaacggaaggtttatccctgattaatcagctgcttctggttacacataaggataaataccttactgaaccgcttgcagagcttatccggattatggttccggatgaaatgcaggcaacctgctaaaatattccttattaactaactttatttcttacacaacacctaaagtggatttttatgtaaaggattgtattatcagggcttttatcgtatagttatatgtaattccgtaagctctccgtgcaataatttctttaccgttgttacttaaagatcgggtaaaataatctcgtataaaatagccattggctttttataaataatattaacttatgaaaagggggactactatggcactcatcaaatgtcctgattgtggaaacgatttttctgaccaagcaccgcactgtccaagctgcggttatatcaactctaattttcggcaacagcaatcaatggtaccaccaaaccctaatggatcacccattccgccgaataacggcaattattcttatgcagtatcacctcaaccagtaaagaaagaatccggattgggaataactgcccttatattttcaattttgggatgcacttttatcgtaggtgctattctcgctatcattgatttatgtaaaaaagatgatacaaaaaaacatacgttatctaaggtttcattaattatagcaggtgtatggctaataataggaattataggtgcagcaggcggtggaaaaaataccgattcttcatcgaaacttgatgttattgaacaggaaagtactgacaccccggaaactgaaacaattaaaattcccgaaaccacatctgctgagactgctgcttcttctgcagaatctgaaaatgatatcgaaaccgtacccgctgtaacttcaaatgaaaccaccggacaaaaaaatgcacttcgttctgcaaaatcatatctcaattattccgcattctcatatcagggattagtagaacaattggaatatgaaaaatattctcatgaagatgcagtttatgccgctgataattgtggtgctgattggaatgaacaggcactcaagtcagcaattacatatttggattattctgctttctcttataacggattgatcgaacagctggaatatgaaggattcactcatgagcaagccgtatatggtgcagataattgtaacgctgattggaatgaacaagcggcaaaatcagctgaagcttatttggactattcatcattttcacgagacagcctgattgatcagctggaatacgaaggctttactcgtgaacaagcaatttatggagctgaagctaatggatattaactaaacgaatatgtagggaagtctgttaataataatttttaaaccttctattcttaaataaactcatccccaagggaatcaatgctttcctgacattgtttttcccttggggattcgttttttccctcttattctttatagactttttctaattttgggtatttaaacttagaaaatatccgttccctcagatattaccaaaatccgaataggaacagcattatattcactttattacactataaaattaataatcataaagaaaattcctactatagaaagaatcaaataaaacatcaatatattttttatcgtatttatattgtcatttattttattcaagacatctggcgaagggatatttgtacttgaactggccgatgccggatacttatccttcaactgagccttaatctgctctttttcctctttactttttgtatcccattcttcctttgttatgcctgcatacaccatagcagatttgcattccgagcatccctgatattcattaggtgttttatgctcagcgcttccaaggtaatgacagttaggacagtaataaatataacgatccattgtattttctcctttatgtatatgatttaaaataatattgttacttgaatctataaggacaattacatctatgcttaaagcatagtcgctcttctttctcatatattgtatcatttgacacaacataaataaatatttagtttaaatatatttacaatatttcaaatggctgcgcagtaagataatttactttatcaatcattatttttctgatataatttaatcgacataaaaaacacatagacaattacattcgacaggaggtggcatattgcctgaatacttgaaattttcttcacgaagtgaattcagaaattggctggaaacaaattgtatgtcagacgaaggggtgtggctgctgttcggcaaagcgggcggccccaaaacaatcaaggccggcgaggcacttgaagaggccctgtgctatggctggatcgacggacagatgcagagccttgatgacaaatcatatgtcaaatatttctctatgcgccgtgaaaacagcaaatggtccgataaaaataagaccattgttgaaagtcttgaaaagcagggattaatgacagagttcggcagggaaaaaatagaagcggcaaagaaaaacggtcaatgggataaacctaaagcacctcccattacagatgaacaaatagctgttttagctgatatattgaaggaatatgaaccggcttatacaaatttccaggcaatgtctccctctgtgaaaaagacgtatacaagagcttactatgatgccaaaacagatgccggccgcgccaatcgtatatcttggatggtggaacggttaaataagaaccttaagccgatgtgaatgattaaaaaggtttgcgaacaaaaattcgcaaacctttttgtttacagtccggatgatatttttcttgaccatagaacagataaagctgctaccagaagttttcccactgcacataccaaaagcaaaacctgtgtggatacaaaatttactccgaatatcgacagcacagtttcccccatgatttttgttactaccgtacctatgaacatagccaggaatgttgcgatatttataataaatcctgcaaatgtcacataatatgtagtatcctccatgggcagattgatatagataaacgataccatcaccaaatcaaagggcacccccacaaaatgctgggccagccgaactactatgtagagccacgtattatctgcttgtacaaatgcatatacaaaataggtaaatgactgcaaaaccacagcgacagcaagcgtaacaaaccatccatgctttttggtaaaaccggcccacatatttgcaaacagcaggccaaacacaaaatacaccgcattcagcccgtttatcagcgtgtaactgattttcaaatcttccaataagtatacattaatggttgcattgggcagataatgtacaatacagcaaacaaatgccactaacatagttccccgataaagcttattcccaaacggcagtatgaatacattagacaattttgttttctctgtatgcgtatacggaaattctttctttacaagcagtaaaatagaatttataaccgtcaggccccacccaatgcagcgaacacatataattaaaggcatttcatgctcagttcccgcaaattggtcagccacaatcgagactgccaatgcgattccccaacagattaaattattgagcatctggcttgttgccatataatctgccttcacatgttccggcagatatgcggcattccacgtcacccctcccgctgaaaacaggttgtttatcagggtcgttcccaccgtaatggcaataaaccccattaatctctgtccagcgtcctcaacaatcataggtaaaagtgtaatccccattatgctgaaaaaatttgtaatcataccagaaaaaaataaaatccattttcttctttgaaagcgttccaggatatatggtgagaatatactgatcaaacatccaaggtaaggcaaaaatgtcagtacaccaactcctgtttgatcaatgccgtatgccaaaagaaaacgggtaaaaaaaactcctccataaaattgctcagctatccccaataataataaagtcagcaacatatacagccgcccacgaccataatcatcttttacgttaaaaagatagcgaaatgtctcgacccagcttctcattttctgttttcatatctccttgcctgaaagttcttcgtttcgctttctgtcatttgccgctttcatttattatgactgtcctgaaatattgctcattttcacattccagttatccatgccattttcacggcgcacctcccatgtcaatccttccgtatttctgttcattacattactaatcatggaatcctttaagtacccttctataagcagcgcatgagcaccattggctaatacattggatatagaaatatttttcaatccatcaggaagattcataccatatgccaaatcggcttctccgatgatgacaccaccaccatgtacaagtccatccggcgcagtatcaatcacaccatcaatcaccacattccagattttacaattacaaggcaacagacgtacctgccaacaaaggtgggaatagccgatcacattcctgataataatatcatgaatatctctatcacgtttggaccagtcaaccggcatcacttcacctgctccaagcctcccgccttctgttgatccggcatacccattgtcagcaatggcagtaagggcgatcatatcatctccggttcttcccgtaatgtccgatataatcagattatgacaaccgttacggacatcgataccatcctggttttcgatattctgacacagtccatctatcatcctggacatacaggcatcaaagttaatgttacgtatacttccgcaggaacatgcttccattgtgattccccaaccgtgagaatcaacaatgcgtaaattctcaataccaaaatgatctacattagccattaaaataccaatatcacgccagtctcctctctgatgctcgccttcttttccggcatcagtaccataagagtgattatgtgaatcccagaagtctaaggattccggttttctgcgctccaccggaatccaatctgccaagcggcacagatcctccggatcataaggacagggctgtgcaagaatcttacctgcatctcctgtggcacggggatgatccgcacccaacagtgtacatgtcccttcacctttaatatagatattgtggatctgcttaggttcagctattccaggcccacagtttgcggaacggaagaaattatccctgcagcggtcggataatttaatcgtgcaattctgtaaaatcacaacggtattttccggaaccagaattgcacgctccaacagccagtaatctcgctcaggttccacctctgaagaacgcggcggaatgattataatcccatccttttcgcgattttccatcgcagcttccaatacctcattatctgtgcatcccaaaaaatcgttcacgttaatcatacagattctgcctccaaaataatcattgttttgtatccaaacctattatttaatcagtccatatccaacaaactgctcttttgcagcatccagatattcctgtccgccgccagcaagccagtcggccacaaaatcttcatagctgtcctcactcacctcacccataatatactttatttcgaattcatccagtttgtcatccagatttgacttcagagtcggattgggtgcgtacaattgatattcattatcccaaacctctgttctttgagccacttcaccactcatctccacgattctgtcaaaataataagaagatatttttgaagtcctggtaaactggctgccatgatagtggtttatcagcatcccccagttctgccatccaaagcttccttctccattcaggtatgcatccgcttcctctatccccgccacagtttctgcatcagcagaagccctttcctcttcagacagcgcccaggttgtgtagttgccattttcgatttcataattacgaccctcttccggatacatgaacatgatgcttcgaatattggcaaagctttcattaaaagtaccgcagtcttcaaagaacttgcagaggatttccattttcacaggatccgcagcacagtcggcagaaacagaaagaacatcacttgccatagcagctaaaggctgactcttacctccacacagatccataagcgtccatctgtcaccgattttatctgcatcttcaccagtcaatttcaggccgagaatcgtctcatcaatcaatgcagacggaggataataacaaataccatatgctccctgataaagagcaggttttctgtcttcccaaccaatggtataccagtcaggattgataaggccttcttctactattgtttttgcaaaatcaagataattcttataagtaccttctaccaatgcgtttgtaacttcaccatccttgatataaatatctggattatcaaacagcatcagcatcctctcaagatcgcctaccgtgccgccgcctgccgcggtaaatccatacgtgtcatccttgccatttccatcgggatcatcaaaagtaaatgcacgcataacatctaacaattcttctgctgtagtcggcatatacagacctaaattatccagccaatcctggcggatcaagaaggaccaaagctgttcaccaggtgcacaggcaatccccttcaactttccatctgctgctgtgtaataggatctctgcagttctgtcatgctttccatccatgtgggcattttatccacatatggagtccagtcatcaatcagaacgccctgatcatacagaagctgcagctgttcaggtctatcaaataaaatcaaatcaggcgcatccccggatgccatacgtgtaatcagctctgtttcgccttcggaagccagagtcattctccattttccgccataattttctccgatataatttgcaacaaaatcctcacccgatggagcaatattcacccagggatttaaaaagaaaacttcaatttccgcgtcagaagccgcttcttcggcaatgttctcttctgcgttttctaccgctgcggtaccttcccgcacactttctgcctgctcaggaacagactttccgcatgcacctacaagcatagcagtcgccatcgttatcgacaatacgtttaacagtttcatactcttcatacaaaagttcctcctattattatttatttctataaacctgatcggccgtatcagcttttatatacttactctttcacagctccggtatacacacctgcagtaaaatatttctgtaaaaaaggataaacacacagtatcggaatcgtgccaaccacaactaccaccatacgaagggatgtgggggtctgaattgcctgtacaccaactttatccattgaagcttctgctcccaaattagcattaatcaataaatttctcagaataagctgcaaagggaatttctcactttttgatcccaaatagatagccgcatcaaaccagctgttccaatgtcctactgctgaaaaaagtcccagggatgcaataaccggtttactcataggcaatactacgcggataaatttcggcaattcactgcatccatcaatttcagccgactccaggacatccttgggaatattggaaaagaactgcctgaacaccaggaccgaccatccatccaccagtccgggaataatcatagcccagaaagtgttcaaaattccaactccggaaaccgttaaaaatgtgggaattgtacccccgttatacaaaatagaaaacaacaccattcccatcaataccttatttccgggaaaatccttccttgaaataatatagcctaatgtcatattgcaaagcatatttgctacagtcccgacaatcactctgacaacacttatccccaagcctttcacataagagtctgttgccaacaggattctacgatatcctgccagggtaggttcacgcggtaataccatcaagtttcccctctgcaaaaactccgtttcacttgtcaaagacaatcccacaacataaactaacggaaaaatactgacgataaccaataatcccaccactatataaataaatgcctgatataatttttccgtattaatttttttcatcccacattcctccagttttaccaaatgccgacacctgcaaattttttaccaagccagttactgaacagaaccagaatcaggcctatggtagattcaaagagtgaaaccgctgatgccaggctatactgcattttaccaagtccctgtctgtacacccatgtcccgattacgtcactgaccgaataattggttggattatagaacaacagaatctgttccactccggcagaagacataatagttcccagattcataatcaatacaaacataacgacccctgtaatacctggtaaagtgatataccggattctttgaatcggacccgccccatccagcttagctgcctcaaaaagttctgtattgatacttgtcaatgccgccaaataaataattgttccccaacccaatcctttccagattccactgccgatcagaatcggaagaaaatattctgatttcatcaggaagttaacagactcaaatcccagcgcttccaatatgtaattgatataaccggtactctgaaataagatctgcacaataccatatacaataacccaagaaaagaaatgaggaatgtataaaacactctggctgaatcttcttattttattactggacatatcaaacaacatgatcgccaaaataatgggtgggaaaaatccgaaacctaatctcagaaaggcaatccgcaatgtattcacgaaaagccgcctgaaatcatcccccataaacaattctttaaaattggccaatcctacatatttgctgttaaatatccccccctttatggaatactctttaaaagataatactaattgcagtaaaaccggccagaaccggaatacaagcagataagcaacgggtatgactgtcagtatataaaacacaccatatttttctattcttttacccaaatcactttttttctgctgtgtgacgtctgctgctttgttctttttccccatatcccctctccttttttataacagttcaaatatgtcttatctgtaactctttttttcattttatcatcggcctgatatgaaaactattgacattggataacactttctaaaaaaaagaacactttttcctaagaaaaagtgttcctggcaatttcacaatcccgctttatattcctttggtgtcatccctgtatactttttaaacagctgataaaaatacggcacatcgtgccctaaaccaatttgttccgcaaccaattccgtcttttttccgtcttcggtttttaacagttctttggctttttccatacggatacctaataaatattcactgtatttaatccctgtttctcttaagaaacaacgcccggtatactttacccctaaatggaccacgttgttcgcaatcaactgcaggtttaagctctcttcattataatgctgccttgtatattcctttattttacgaaccgttaaggattctttttcccctgcacccagcagttcattcaacgtgtaaactgcaacatcataaatatcccaatctgtacaaaaaagtctggaaacgcattccaatagtgatttactattatccaaagagttggcaaccagataaatcaatgcagtactgagcaaacttaaatccgaatatgccgtcatcaatacccgaaccttttccgcatctaccgtatcattattttcccgtaaaagctgtaactcccaagcaattttttctgtcaattcggttcgtttgtccagatttattaactgttcatgggttctgtcccaaatttgctttttacaattttccaaaaccgtttcaaactccgatttagaaaaaggttttaataagtaatattttaccccctgttccatagctgtttttgcaagttcaaactccgcatatccacttaaaacaacacattctattaagggattcatacgctttgttttttcgattaactccaaaccattcataacaggcattcgaacatctgtaaccaaaatatccggcacctcatctatcatacagtctaaagcatccatcgaatttgtacagcatccaatcaattccactcctatctgctcccatgaaattgtttttcgtatttgttccaacacgaaggcctcatcatcaaccaacattagttttactacattcataatatcctattccctctatttagcggtttatttcggggaatcagaatactgacctgcattccattttctatcctggtaaaccgcagccctgatttttcagaaaaagcatactggagacgatgatggatatttttcaaagctattccgctacctcctgttccctgttggctgcttctatctatcaaaatatcttcatcaaaaccaaccccattatcttctacaacgatttctgctgtgttttcatcgcctctttcaaatatccgaatcatgcaatttgaaatcatctcatccagaccatacagcacagaattttctaccagaggctgaatagtgattttaggaatcagcagttttcttgtctgttcactgacttctatggatacctgcagccgtgacccataccgcagctgttgtattttcacataatcctccacaatctgcagatcctgatccacactgatcatagtttccctttgatccgtgatcatccgcatcatcctccccaatgtctctatcatatgggccgtttcttcatcttctttagcgtaagccatccacgtaattgccgataacgtattatacaaaagatgcggctgaatttgtttttgcatccaggaaaattccatctccttcaaggccattttattttcataatgggcatctgtcagttttttataatcatctgtcatctgataaaaatgttgatatatttgtccaatctcatcttcccgttctaaatagagccgttcttcttcccgggtcagcagaattccttttccataatcatccattttgcaaataatgcgccctatttctttgatcatcaatttgaccagaatattactaaataatatcgctaaaaccactgcaaatacagaacagagcaacgaaaccatatatactttttgaatctcgctttgcatttctgcataattacttcgcagaatcatggtatagcctaatccaggggaggtaaacacgacgaaaaagctatcatcttcggtataccaaccatctgcgtaatcttgataatgttccagttctttagtattgctgtacaaacaaatattatccgtatagactgcaagatccatatcctgagcttcattattagcaaaggcatttctcatatccattataatttccccgaaatccacccaggcaagtatatatcctatgtgcatatattcagaaccggatatcttacggagttctcttaccagaagaagtcttccctcctcctcaatcattactaatctgccgcctgcgttctcagcaagctccatatatttgtcaaaatcttctttttcaaacaaactgccataactgaattgatatgcatctgttttcaacaaaaagtatttaaaataaggttctttttgaaaatatgttttgattctggcatttgcagccctcaaattgaaagaatatccctgctttcgatagtttttggcaatataatccaactcatcctggagattctgatcccctgcaattgcataggttactgcttcaatgcggtcaaacactgtttcaatataattcacgtaaaaacttaatattcttgcgttttgcatataaattttctgattataattattataagcatactggcggttaaacatctctattaaaaacagacttatgaccactaacataattaaaaaagaaaactttttggagagcttcagattgataaaccattttctcacaaacatccctcctgtaatcgtatcaaacttccgtagtctttatcccgcttttaagtcaaatcctgactctctgccttttactctggaggtttttttctatgaataatagcattatcattttataacattttcttgcaaaaataattttaaaaaggagcactatttattaaaaaaaggaatacaatcatatctcaaaacatatagtggcagtattgcccccgcagaatctgcttaatgcagtattgtatccgccataaatttgtaaacttacctgtctgtgtgaagaaccatatactattccatgctccgctgaaaacgggtgtatggaatcttgtcataaaaaaagaagggccaccatgaaatagggctcttccgtttattccaataggatactacttaccacagaataaccattagacgctcatcctgttcaacagctgccttgtaattcaggtcattggaattgcataaaaagaaaatacaggaaaagctgaaaataacagcttttcctgtattccaattcctgccggcggcgggacttgaacccgcacgtggttgcccacaacagattttgagtctgcctcgtctgccattccgacacgccggcatttcggcttcattgtccacaactcagccgaagattataataccatatctgaaagtttctgacaagcattttcacatgactttttcaaaaaacttttacatataatttcttctgataagactaaaaattgaatttatcatatatctcaaagcagtcgaatgttgcaaaataatcctttggagtctccgctcttcttatcagctgcacatccccgttttctttcagcaaaagctcggaggatttgagcttgccgttataattatatcccatagcaaagccgtgggcacctgtatcatgaataaccaggtaatcccccatatccactttgggaagcatcctgtctatagcaaacttatcattattttcacaaagagaccctgtcacatcatacatatggtcgcaggcctgtccttcctttcctaaaacagttatgtgatgataagctccatacatggcgggcctcatcaggtttaccgcacatgcatcgcagccaatatattccttatgagtgtgtttttcatgtatggcctgtgttacgagatgcccgtagggagccatcataaaccgtcccagttccgtacaaattgccacatctcccattccggcaggcaccagcacttcctcatacatttttcttacgccctctccgattgcaagaatatcattgccctcctgatccggaagatacggaacccctataccgcctgagagatttataaagcggatatccgcgcctgtttcctccttcagcctgacagccagttcaaacatttcctttgccaaaacaggataatattcattggtaacagtattgcttgcaagaaaagcatggataccgaaatgcttcacacccttttctttcagaatacggaagccctcaaacatctgctctgtcgtaaacccatatttggcatccccggggttatccataatgccattgcttattttgaatacgccgccgggattgtaacggcagctcatggtttccggaagttttcccatgatctcttccaaaaattctatatgcgtaatatcatccagattaatagtggctcccagctttgccgcataaacaaactcctccgcaggcgtatcgttggaggaaaacataatatcctcccccttaactcccattgcctcactcagcatcaattctgtcagtgaggaacaatcacagccgcagccatagtctctcagaatatctatcagaaaaggattcggagtcgccttaacggcaaaaaattccttatatcctttattccaggaaaaagcctgttttaatttctgcgcattttcacgtatccctttttcatcataaatatggaagggggtcggataggttttcacaatttcttccacttgttctttcgtcacgaacggtactttattcattttcatgcttctccttttgctttcttcttcttaccggtaagttcgatcaacttaatctcatttcgcatggcttccttcagggcatccacaaataccctctggccggaatacagacagatatccctgctgcttccagtgagttcaccggtaagaacatatttggaatcagatatcagacgaacctgattttcttttccttctgttttatagcagactgctgttttcagccgctccggtatcttatctgaaagaaggacaacctttatttttttctgcagcagttcatatatatcctgttccatttccgcaattcttgttcctgacgcggaaaggtaaactctcttttctgcctgctccatcatgtggtgcatcttatcaaggatctgctgttcccccataattgtgatataaccatcactgggctcatcagccgccggcatgttatctgacagccactgcttggtattccccatcatacgaagcttgttgtcacagaattcctctacgggaacagccatatacttactgctgctgccctccattaaataggcggcgcccttttccgccagccccgctaacgcattatagacattggaacgggaaattccggtcagctttgccgcttcatatccggtaagtgtaccatttctgtacaggcacaggtaaattgaggcttcctgccttgtcagaccgaacaccatcagcttttcaatataactcatttcatccataggctgcctcacaatcatcctcattagtagttccgtacaggaacactatagactgtcattttccatttgtcaagtccgaaaaaagaaatgataaaaagcctcatcaggcttttatacctgacaagacttttattttatccgaatcttttttaatctgtcccatttaagcctgatttctttccttcccagtaatcaagccctttccaatcggcataaacacaggtctccacaacggtaacgccttccattatatgatactgcacagccggtataacggccttaggataaagaagattggtattaggatccgcatcaataataacacctgcctccggcacccgctctcctgcaacttccgtatattttcctgtcactctgcaaaaagcatagcggttctcagccagaactgtcccctcttctgttttgccggtaaattcatcggaagggtccgacgcaataccgaagccgcagtcatatgccgcacaactaatgttacttacaattctgtgtattcttttatgtccccattcttccggaatcacaacggtttccacctggattttgggataaggggaccatacagaaaccactttttcttccgatactgtaaaatcctcacatattctccgcacatacacatatccgtcaataagaaaggccagcatactgtccggggccgcctcatgaagctcaaaattagacttcgcaacatgaaaaccaaatctggtatcataagcaaatttcccatattttgcctgactctgtccatgtccagaggaactgtatctgcccgggacataagccgtatgatggcctgcatgggccgctataagcatatccgcatagagaagcagcctggttttttccaaaggcggcaaaggggcgggtacagccgtccagaattcatgatcatcaggaagctgcagaaatgcaaaggttttcatcgcccagtagggcgaaccgggcccgttataacgctctcccattatcagatccggatacccatacccaattgtcagaataccgtccctgtcaaatatcggcttcttcatccagtcctgcagatgacggactatcagtcccttaatcacccccacagaaaagggatatacccccgccatcaggcaggcagaccaaaagctgacctgagcaaaccgataagtaagagaacgtccaaaaggcagggctgctccctcttcatcaaaccaatagataaaggtttttccgaacagcattgcccgttctttatagatacggcagcgctccgggtcctctttctccatgacgctggcataaaaaaggcagtaaaaatgaatagcaaaagaaacataataatccttttgtccggaatcgccatcctgataccatccatcacccaaatagaattcttccacgcccttaagatatatctccagctttttactgtcatatttcctgccgcgtttcatcagggccacattcaccagtaccgcaaacagaatccaattacatacaggaaggtcataatcgttaatgccgtacagccagctgctcagatgttccttttccgattccgaaagaggatcccacagcttttgcggagtgaggatcagcccataagctatcgccgccatctcgacgaatttctggtcaaacgcatgaaaaccgccccaaaattcaggattacccggatcgataccggctttcaggcccttccggtatatttcttcaaatccggtttcttctccgcctcccgcccagaaaggcaccaatccccataaaggccgtgaaaaggattccatcccttccgcctttctgtcataattggtagctgtgacccctaatatgagttcagccttctctctgctgtaataaggcttaagaggttcaaggacagaaagcataagcctctgaaaatcttctttggaatacagatccatatttctccgtctccttattctgatttgtcagatattttctatctgccagtcgacaggctctacgccattgttctttaagaagtcattggcctggctgaaatgcctgcatcccataaatccgcggaaagccgaaagcgggctgggatgaggtgccttcaatatcaaatgcttcggattggtcagcatggggattttactctgtgcaggccttccccacagcatatataccaccggccggtcctgatggttcaccgcttcaattacagcatccgtaaactgctcccaaccctgtccctggtgggaattggcccggtgcgccctgactgtcaataccgtattcagcataagtactccctgatccgcccatttctttaaataaccgttattcggtatataacagcccagatcatcatgcagctcctgataaatattcaccagtgacggaggtatctccttctgctccggttttacggaaaagctgaggccatgggcctggttttcattatgatagggatcctgtcccagaatcactacctttaccttacttaacggtgtaaaatgaaaagcattaaaaatctcatccgccggcggatagaccacatatgtggaatattccttttgtacgaaccgaaacagctgcgcgtaatatggctttttaaactccccgcttatttcatccagccagtcattttgaatcattcccatcttttgtatctcctaccttttattttcttattacaagaaaagcgcttctacaaacgtacagaaactccttttccctgaaggtattcctttacctccctgatttccagctccttataatgaaaaagagaggcggcaagaacagcttccgcacggccctccacaagcgcatcatagaaatgctccagttttccggctccgccggatgcgattaccggtatcggcaccatatcggctatttttctggtcagttcgatatcatatcctgcttttgtcccatcacaatccatactggtaagcaaaatctccccggcccccaaacgggttaccttttccgcccagaaaaaggcgtcaatccccatgtcaatccttccgccatttttataaatattccatccgctgccatccggccgtctcttgacatccatggcaactaccacgcattggcttccgaacttatccgccgcctcagaaatcaattccggcctgttaatagcagaagagtttatggatattttatccgccccttcccgcagcagtaccttgaaatcttccacggtacggattcctcctcctacggtaaacggtataaataccttctccgcaactttacgaaccatatcaactaccgttttcctgtcatcggaagaggctgtgatatcaagaaaaacaagttcatccgctcccgccttatcataagcctcgccgatttccaccggatccccggcatcctgaagattaacaaaattaacgccttttaccactcttccgttatgtacgtccaggcagggtattattctttttgtatgcatcactatatctccttattatgtgagagaaataaaattctttaatatggtaagtccaacggccgaacttttctccggatggaactgacacgcgaaaatattatctttttccacagaagcatgaatacgtgtgccgtattccgtttccgccgtaacaatagaaggatccgaagacctcagataataagaatggacaaaataaacatacgaattttcttttacccctgtaaaaagacgccccggattgggataggataaggaattccatccgatatgggggattttcaggcctggcgcttccggtatgcgaagtatttcacccggcaggataccaagtccgtccacgccttcgctttcttcacttctctcaaacaaaagctgaagtcccagacagattcccaaaaatggagttcccttttcagccacttccctgattacatctgtaagcccataatcctccagtttctgcatcgcatcaccaaaagcgcctaccccggggagaatcaccttatcagcctccaaaatacaagctttgtcccttgtaattaccgcattttctcccaacgcctgaagggctttttccacactctttatatttcctgcatcataatcaataatcgctaccatgcctgctgtccttcccttcttccaacttttactttatctcattaccgtagtgtagcacacttgcagtctatccgcaatatttcacccttgatttccttcctctgataaaaacgtaatggcatcagtttttgcggaaattcctctttcagacagttcttccgtcaaatagggaagtttcccgtgaacccggtaaaatacagacttttggttaaaaaaagctactttttcaaagggaaaacggattactgaaggatattccattcccgcacccagctctaaaatacaaagcttatgatttaatgttccctgaagccattttgtatatttttcccactgtgtaaggtagccttcttcccggtaaccaggtgtttctatgcgattaaaccaaaggatgccgcagcagtccgtacaaacaggaaagtccaccgatgaaaggtctccattgcagttatcaatttcttcaagcacctgcagaatcactttatcatccgttacaagagattcctgctccgcattgcatttctccgtacactgtaattcccggaaacctccgcagggcgttacaattcgttctctgtccagacctgaattaaaaatatagtcatcctccgacaaagacagaataaaataatttttcccatccagaagggccgtcagcttttcataagctttctttatacggggatttggatgtctgcgcacataatggcaccgaagatactgaataatagcagctctgtccttttcttcttccgcctgggcaagcagaggcccataaaaggtgtcttcattcattccctgataattctcttccatttcttttccgattccaaccagaaccatctgagaatctgctatatcctgcagcaattcatttgtcattttctcttcctcttcatctaagcctttacaaactttttatcttgttaatagtatcatgttgagcacagtgcatcaagtaatgaaatcttctggctgcaatgaaatcctccaaatatttccacacaaaaaaaccttatctgaaaacagataaggcaaataaacaataaacaaaatccataccctcaaaaccgaacattgaatttaatctcttttcaaactttccaaaacttactttcccataccttcaggataagccctcgaccgattagtactggtcagctacatacattactgcacttccacctccagcctatctacctcatactctctaaggggtcttacttattgggatatctcatcttgaggggggcttcacgcttagatgccttcagcgtttatccctgccggacttggctactctgccatggttttggtaaccaacagattcaccagcggtccgtccatcccggtcctctcgtactaaggacagctcctctcaaatatccttcgcctgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagtcctactttcgtacctgctccacccgtcggtgtcacagtcaagctcccttatgcctttgcactcttcggatggtttccaaccatcctgagggaacctttgagcgcctccgataccctttcggaggcgaccgccccagtcaaactccccgccagacattgtcccccgcccgggtcacgggcgcaggttagaaacccaatgctgcaagagtggtatcccaacagtgactccatgattactggcgtaatcacttcttagtctcccacctatcctgtacatacagcatcgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcggagcttcgttgcctgactcctcctcttaaccttccagcaccgggcaggcgtcagcccatatacctcacctttcggtttcgcatagacctgtgtttttgctaaacagttgcttgagcctattctctgcggcctcctttcagaggcaccccttctcccgaagttacggggtcattttgccgagttccttaacaatgcttctcccgccggccttaggattctctcctcatccacctgtgtcggtttacggtacgggtatcatatgagcaatagcggcttttctcgacagctggctcacctgcttccctactttaattcggtacgcgtcacgccttcggattgctggacggatttgccagtccagctcctacttcgcttgcaccgggtttccctttcccggctcaggctttccctctgtgtccccacagttctgtcatatgatagtacaggaatctcaacctgttgtccatcggctacgtctttcgacctcgccttaggccccgacttacccagggcagatcagctttaccctggaaaccttagatattcggcctggaggattctcacctccatctcgctactcattccggcattctctcttcttaccagtccacaataccttacaatactgcttcttcccggtaagaatgctcctctaccaacgtgattactcacattcctaagcttcggtgtcgtgtttcagccccggacattttcggcgcaggacctctcgactagtgagctattacgcactctttgaatgtatggctgcttctaagccaacatcctagttgtctctgaaatcccacatccttttccacttaacacgtactttgggaccttagctgtaggtctgggctctttcccttttgactgcccaacttatctcgtgcagtctgactcccgtacatcattcctatggcattcggagtttgatattcttcggtagactttgacgccccctaggaaattcagtgctctacctccatggaattaatacgaggctagccctaaagctatttcgaggagaaccagctatctccgggttcgattggaatttctcccctatccacacctcatcgccacccttttcaacggatgtgcgttcggtcctccattgccttttacggcaacttcaacctggacatggatagatcacccggtttcgggtctgcagatactgactacgtagatgcagagcatctatcacgcgctgttaacacttggtttcccttcggctccgtccctgaaggacttaaccttgccagcacccacaactcgccggaccgttctacaaaaagtacgcggttgtaccctgatggtacttccacagcttgtaaacacaaggtttcaggttctctttcactcccctcccggggtccttttcacctttccttcacagtactatgcgctatcggtcactaaggagtatttagccttacggggtggtccccgcttattcccacaaggtttctcgtgtctcgtggtactctggatcctgctgtccaaacttggttttcgcttacggggctttcaccctctctggccggtctttccaggaccgttctgctaaccgcatctgtaacgtatgcagtccgaaccccagcatgcacgcacactggtttgggctcttccgttttcgctcgccgctactcacagaatcgatatattttctttctcttcctccggctacttagatgtttcagttcaccgggttccctccgcatccctatggattcagaatacggtgacggaggtttgctccgccgggtttccccattcagacatctgcgggtcacaggatatttgctcctcaccgcagcttttcgcagcttatcacgtctttcatcggctcttagtgccaaggcatccaccttgtgctctttacagcttaacctgtttgtaactcgtccttacttggtctcgttacggcatacatagcgttgtatgctctttttggtatttcttcccattctttcgaatggattattgcttgttttggatgtcttctcgtttatcttcttctatccggttggttcctttcgaaaccttccttaaatagacgttgatactttaagattattttcaatattcggttttcaaggtacggattcttttctttggatgtttccatccagtggagacggagagattcgaactcttgaccccctgcttgcaaggcaggtgctctcccaactgagctacgcccccattcctgacggttcactcgtttggttattcagaaagtcactctttcaagttttcttccaggtcttttctccgccagtgggcttaagtggactcgaaccaccgacctcacgcttatcaggcgtgcgctctaaccggctgagctataagccctcattgtccggtccggattgctttcgcttccctttccttctatatgagtatttaattgtttttgttgtaatccggcagccacctgctctcccataccgtttccagcatagtaccatcggccgcttaagtcttaaccatcgtgttcgggatgagaacgggtgtctcccctaagcgtatcgccaccggaattcttttttcctgatgttcccagagccttccggctcccttaacatctaaacagtaatacaacccctacttcttcgccttagaaaggaggtgatccagccgcaccttccgatacggctaccttgttacgacttcaccccagttatcagacctgccttcggctgctcctccctttcggttaggtcacagacttcgggcatttccaactcccatggtgtgacgggcggtgtgtacaagacccgggaacgtattcaccgcgacatgctgattcgcgattactagcgattccagcttcatgtagtcgagttgcagactacaatccgaactgagacgttatttctgggatttgctccacatcgctgtctcgcttccctttgtttacgccattgtagcacgtgtgtagcccaaatcataaggggcatgatgatttgacgtcatccccgccttcctccgggttatccccggcagtctccttagagtgcccagccttacctgctggctactaagaataagggttgcgctcgttgcgggacttaacccaacatctcacgacacgagctgacgacaaccatgcaccacctgtctcccctgtcccgaaggcctatctcttttacaagatattcagggggatgtcaagacttggtaaggttcttcgcgttgcttcgaattaaaccacatgctccaccgcttgtgcgggtccccgtcaattcctttgagtttcattcttgcgaacgtactccccaggtggattgcttattgcgttagctgcggcaccgatgggtccatacccacctacacctagcaatcatcgtttaccgcgtggactaccagggtatctaatcctgtttgctccccacgctttcgagcctcaacgtcagttacagtccagtaagccgccttcgccactggtgttcctcctaatatctacgcatttcaccgctacactaggaattccgcttacctctcctgcactccagcctgacagttccaaatgcaatcccaaggttgagccctgggttttcacatctggcttgccatgccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcaccctctcaggccggctactgatcgtcgctttggtaggccgttaccctgccaactggctaatcagacgcgggaccatcctgtaccaccggagtttttcacactgcttcatgtgaagctgtgcgcttatgcggtattagcacctatttctaagtgttatcccccggtacagggcaggtttcccacgcgttactcacccgtccgccactaagttataccgattccatccgaaaacttcctctgtgtaacttcgttcgacttgcatgtgttaggcacgccgccagcgttcatcctgagccaggatcaaactctcttgtttaagtgtttaatccggttaagattaactctagctaatgtttaaccgtttgtttgtttccaaacatttcttactgtttttgggtgtcttaaaggtcttctctcgaagctttaaaacttgttctctgaattttcttttttagaattttcagggttgcattactgtttatttgtcaaggttctgtgtgctgctttctcagccgcaacagttgatatcttatcacatgttgttctgccagtcaagcacttttttaactttttatttttgtttgttaccggtttgaccggcagcaaaaatgattctatcatcccggttcgactttgtcaatcatatttttacatttttttacaaaagattttacaatggcttctgcaataacagaaaccgcctgaaaacaagcggtttctttacacttctgccatttacttatcactgataaaaacttactcttctcccaccttctccatctcaaaccagaattccacaccattctcgtaattcacaacaccgtatttctggttcatggattccatgatcgcttttacaatggaaaggccgacaccgctgcctccatattctctcgttctcgctttatccactttataaaatttctcccacaaatgaggaagcgattcttccggtatgggtatcccggaattgaaaacagatatccttactttttttccttcctggctcagcttaatatccactaccctttctccgtccaaatggtttaatgcgttggtgaagtagttcataaagacttcttccgtcttaaattcatcaccccagacataaaccggctcctccttttcgaaacgtactgccgcctcattctgtttaatgagaatatccgccgactgaatataattcctgataagggtaacaatatcgaaccgctccatcgataccacatcatttccgaattccagctgattcaatgtaagaagcttctttaccatattattcattttgccggattcatctatgataacatcacagtaaaaattcctgctctcttcatcatcgtcattaattccttccttcaggccttccgcatatccctgaatcagcgcaatgggagttttcagttcgtgagaaacgttggaaagaaattccttacgcatctcgtccacttcatttttcttctcgatatccttctgcaatacattattcgcagttttcaattcagatatggtcgcttccagagtatccgcaagctggttgatatggtttcccagtatggcagtttcattaaaactctttccctggtatctcgcatcaaaatccagatgggtcatacgttcggaaatgcgggcaagctccagaataggatccgttacctttttggtgacaatccatattatgataccgctggcgattgtcgccgctatccctacatatgcaagaaaacgattggcaatatcaacgctgtcccggatgccttccagcgctgtccttataaaaaacagattcccgttatccaggaatccccacatatccagataatccatgctgacccggttgcttgtcaccagctgtactatatagaaaggactttcattacgcaccagagtcttattggcaattgtattttcaccgtacttctgtccctgattcttgccgggccggtccgatacgctgccgccgccactgtccatactgtcaaaaagaacatgattccacaattcaattttcaggatggaaggatcccctccgcttacacgtatggtttcggagtcttcatccagaacaagaatggatatattgtatctggcgctgagctgctgaagatggatatcaaaatcatccgagttaatgcttcccttctgggctgcagcgttcatctgtttgtaagcatccataaccacggtctgtttgttatgaaaataatatttttccaggaaggtattattaataaaccagcacaataaaattgtgccggccattaatccgataaatatacaggcaaattgctttctgatcgaatatctcatgcttcatcaacctcgaatttatagcccatgccccagatagtctttatcatatctcctttgactcccagtttgctgcgcagctttttcacatgagtatctatggttctggcatcaccgaaataatcataattccatacattgttcagaatcttctctctggaaagagcgattcccttgttttccataaagtaggtcaacagttcaaattccttatagctcaattccacattctggccatcaatagtaaccatatgagccgcctgatccagatgaatgccgccggcctccatcacatcaccgctggcagcctttcccgctcttctcagaatagcctcgacgcgggccaccaggattttggggctgaagggcttggaaatatattcatccacgcctaaatcgaacccctgcagctcatccttttcatccccctttgccgtcagcataataatggggaccttggaataattacggatttccctgcatacctgccatccgtccattttaggcatcatcacatccagtataatcaatgcaatatcattctgttcaaagaaaatatcaagcgcttcactgccgtctccggcttccagcacttcataattatttttctggagaaaatccttcaccagcttgcgcattctgctttcatcatccacaacaagaatttttgtccgttccatagcaacctcgattctgccggcaggaaccggcgatttcctatgattcaaagtcattcatccgctttacttacagtgtaacagatatttatgaaaaacatgtgaacttttcggcctttttccaccttttccatgtagttgcctgccggaacggatcttccttattccaccttttccagctgacgcccttctttaaaaagcttttccgtcctttccatcaccttataataagcaatgatcaggaacacatcggccattacccaggccagaggacttgcaaagcccacagccgcaaacccgaaaacaggaaccagaatgaatccggccaaagctctcgctatcatttcactgactccggataaaatagcaagcatactgtagcccattccctggattaaaaaccggatattattcaccagagacagcgggaaataaaaaatagaattgcagagcaggaaaagcttgacattcgataaaatcgcttcttccgaaccatccacaaacagcagtgccagctttccgcctgccagcgcgatgatacagaaggacaccaccgcataaaccgctcctatcatatttgcagagcggattccctgtctgatgcgatccgtcctgcccgctcccatattctgtcccgcaaaagtagccatcgtggcaccgagcgaatcaaaaggacatgcaaaaaatccgccgatcctgctggcagccgtcatggaggctacggcaatggatcccagggagtttaccgcactctgcaggataacgcttcctattgcagtgacggaatactgcagccccatgggaattcccatgctgcacagattcttcacatattgggattccagtttccattcgtctttcctgatatgtaaaatatcgaattttttcctcatatacagcaggcagctgacacctgataccgcctgggagaccacggttgcaaccgccgctccggccactcccatatgcaggactatgatacagaatagatccaggaagatattcagaaaagcggaaaggatcagaaaatacaggggcgttttgctgtctcccatggcccggaggatacctgaaaccatattatacagaatggtggcaggaataccggcaaaaataatcacaatataggtatatgctcccgtaaaaatatcatccggcgtccgcatcagccggagaataggtttgcagagtattatcgtcgctatcgtcataatcaccgcaaaaagcagggccagccaggtactgttagccacatactttctcaatgttttatcatttttggcgccgaagctctgggcaacaggaatggcgaagccattgcagatgcccatacagaaaccgattatcaggaaattaatggagcctgtgctccccactgccgcgagtgaattcactcccagaacctttcccacaattacagtatccaccagattataaaactgctgaaacagatttcccaataaaagaggcactgcaaaccccagtatcaattttatcggttttccattggtcatatcctttgtcatgttttatccccgcttttcacatatttctatatgtggtataacatatcggaatacagattacaaacattttttacataaaattagccgggactttatatcccggcctgattttcagcattctctgtttttaagtctgtccatgacatttactgcaaaagccgccgcattctttaaatcctccgcatcgggatgcagcagtgcctcgtcaaaattacggagcatcgcctttacttttgcttcttccattccgctgttttccatcatttcatatttttgacggacctgcatgggcattttcccctggcacatgtatgccccgagatatctgcagtcctccgggagccagacctttaccttttgttctatacttttgtagtattcttcatttgtccccattccgcaggtgccgaataatgccacattttttcctttcagctcagacagcagatccaccacccgcatatcacaggttcctttatctgtccagaaaccgacaaaataagtttccgcatcttttccactatattcgtctatagactgcatatccttggagtcaccggggattgccgcaaatatactggaagctatttttttggtgttgcccgtatggcttgaataaataaccattacttccattttacgtactcctttcttttttccatccgcttgcgcgttaaaaacgtcctattggaataccgcctccacagcataatccaccgcccccgcagcacatattacagatgagattggcaatacacagcttcaggcaccagttgctgccgtccattgcaggcattccgtatggagactgctgggtctgataccagcttcctccggattccatctgctgctgccacactctgtactgctgattcccgggttccatagccgccgccttcttcgcatggtcaagcgcaatcacgttatttcccagcccggaattcgctatggaactgtaataataccattgggccgttctgtcactgattccggaaagcacattgagagcctcccggaaatgtctgctttgaatataattataagcggctttcatatgaaccgtatattcatcaccgccgtcattgctctgcgcccttcggtagctctgcccgccaaagccaaagctgccgaacaaatcctcaaaatcaccgaagcctccaaagtcctgatagcctcctccggagcttccggaggaagtgctgctcccgtagctgctcgttcctctctgcctttcgtccatgattctttgataagcctgctggatttccttgaacttttcctctgcctgctccttattcggattattcacattggcatccggatgatattttctgcttaatgctcgatatgctttctttatttcttcatctgatgcatccctggacacaccaagtacctgatatggatcacgcattttcctgctgttcctttcttttgccctttaccatctcataccggcaccaaacaccggaataaaggatgttccgcagaatatcaacattctgaaggacagggagtttttcaaaagctctggagcattctgccatcatcatccgcaaaatatggtagacctcatcgtcaaaaccattttcaccgcacatggaaagaaaagggttaaaattccccttcttccgatccttttcgatatcttcataggcatccatcagataaataaatttccccaggaaaaatcccattttccgaagttcttcttcccattcgtcatttttgagtgcaaaaatctccgccattatattaccaaagcatcccgctacaatgtcaagatttttttcatttttcttttcacactcatggagaagctgcatctgtccggaaatctcctccgcctttttgggataacgcgccgccgcttcgccaaaggctcttttcagaattcccgcatagcctcttttccagacttttttctcgtcttcccagtcatccatgcactgataataagtcatcaatatgtttatatcagcggcatactccgtaaacgtatttgctcttgtcggatgacggtcaaaaggatgggcaatacacttacagccgtccaccttatcctctacttcatacagacccttcagcagtaaaatcaggaaagtcatatcataggttactgtgatctggcctttcaccccgtaccgtttcttaagctcctgacagaatccgcagtaataggactggtaaacttcaaaatctttgaacttcatttcctgtttattcacaattacataaccgaacatgcttttctcccgtcagctcttcttaataaattccgtatggcacttcgggcatcggatcgctatttttccttttcccctgggaactctgattttctgtttgcatccgggacatttgtatatatgatgcgttttccgatctttcatatccctttgaaaggaggcccattttctccggataccggctgtcatctgcaggtatttctgattttcggcatatcttttggtgatacttttggaaaacatgcggaaataacaatagaccagaagcagcagaattaaaaatgaccataccatgcttcttgtaaaaagggaaagaatcatacagaccagcgccactcccataagaaatttggtaaactggtccactccatatcgtccctgcataaaacgtatcagcttttctttcattctctctcctatccgcgcacctatacacgcgcccgggactgaatcaggcccgggcagtatgatgtttatgtcctttattttacctctgtcaccggaaattgcaattaactggctgaaaacttactattaaaaaagtataaacctttcccatatgaccatactaaaaatattccatctgtgcagttttgtgccgctcagatgtacctcaaacacagttcattgataaaggagtgaaaaaaatgtccaaggattttagaaacagcgaaacgaaagataatctgatgcgggctttcgcaggggaaagccaagccaggaaccgttatacctttgcggcctcacaggcacgtaaagacggcctccatgtcattgaagcagtttttacctttaccgcaaatcaggaaaaagaacatgcggagatcttttacaatcatctcaaagaactcagcggtgaaacaatcgtggtggacggaggctacccggttgatatttatcccgatgtgaaacaattgctgctgtccgcccagcataatgaatatgaggaatatgatcccatttacaaagtgttcggtgacaaagccaaagaagaaggttttgataaggtggctgcttccttccatatgatttccgccatagaaaaaactcatggtgaccgttttggtaaattcgcccagcttatggagcagaacaagctcttcatttcggatgtggaaaccggatggatctgcctcaactgcggctatgtctataccggcaccaatgcgcccgaaaaatgtcctgtttgtgatcatgacaaaggatattttatccgtctgtccatgtctcctttttcagagtaaaataaatgccggaaagaacagtctctctttttctttccggcattttgatccattatcttaatatagtaaaccggaatacatattttcctgctttccttcccggacaatctgttatatgatagattttcaggaggatttacaacatgaaaaaacaacataaaagacctgataagttcaggaaaagcaggctccaccctcaattgcccctccgtgctgtcctgtcttttttcctgtgcgcctttcttctttcggcttccggatgcacagggatacagccttccggttcaggatccgtttcttccggggacgaaggaaatacactccaggatatttccggtaccgtaaaggttcattttattgatgtgggccagggtgattccattctcatccaatccgggaaggaatgtatgcttgtggacgccggcactaatgaaaccggaacggaagtcgtccggtatcttaagtcccttggaatcagccgtcttgcttatttgataggaactcatccccacgaagatcatatcggaggcttggatgatgtgatccattcctttgatatcggcacagttatcatgcccgatgtctctcataccacgcggacctatgaggatgtgctggatgccctgattgataaggatctgaaggtaacgaagcctgttcccggaaccgtatatcagctgggagaagcgtcctttaccatactctctcccacagaggaggtcgaacagcaggctgccgctgccggcgatttgaataatctttccgtggggctccgccttaccttcggagccaatgcctttgttatgtgcggcgacgcggaaacgctttctgaagaggctattgtggaaagcggactgactctgaaggctgatgtccttaagcttggacatcatggcagctccacttcaacctgcgattcttttctgcaggcagtgtctccgtccatagcggtggtctcctgcgggaaagacaacagttatggccatccgcatcgggaaaccatggataaactggcagccgaaggtataacggtttacaggacggacgaacagggaaccctgacagccacttccgacggttccgtaataacgtggaataccggatccggcgcttccgccgataccggaatactgtctgatgaatcagcttctgaaggaaaaacaatcgccgacagtaattcatatgtgttaaataaaaacagtatgaaattccatcttcccgactgttcatccgtggaaaaaatgaaggaatccaataaaatttatttcggcggaagccgggatgaagtcatcggaatgggttatgcgccgtgcagtcagtgcaatccctgatacataggacgccatactgtccggatcatccatatgttccgtaaaaggcttacgccgatatagaagaaaggaaaattatgaaatacattattgacagatttgaagaaggcaatgccgtatgtgaacaggaagaccgtaccatgcttcttatttcacgaagccagctcccttctgacgccaaagaaggggatgtcattctgtataccgacggtgtctatcaggtggacaaagaggccactctggaacggaaaaagaaaatagaagaaaagcgcaggaaattattcggctgaatttaatctggcggtttatctcaatcgcagcttatcacatctgtaaatatgccctgccgggtgtacagtaaaaacaggcagatatctcgtaagagacggctgcctgttttttgtaaaaagcttattcttccccttccaccgcaagcaaaaacagatcattaaaccgttccagctcatcgtacacgattccatggccgctgttctccagctggaacagtctggaaccggtaatctccatatgttgatattccacaagctgtgaggataccaccacatctttttttccgtgaataataacggtaggtacattaactgcctccaaatcattccgtccgtcttcatctctcagggaaatggctgcctggaccgtaccgataccggacgccgaaagagcgatatccccgaaccagtcttttatctgttctgactgacagcttgcaaaaagctgttcatggctgaattcccaggccagcctgggccgatccgtacaggcctgccttatcaatccgttcacgtattcccttgtgagcccatatggaaatccttccctccgcgtccagcagggcgctgccgccgcaagcagtatcagacgctccaccccgtagcattgatattttctcatatacctgagcactacagcacctcccatggaaaagcccacaagaacaaaccggttcagccggagggcacagattacacggtaaatatcatcagccatctgatcgtaggaataaccataggccggcacatccgaatttccaaaacctctcaaatccagagacacaacacgatatccgcaggataacagcatttccagctgatattcatacatctgatgggacagaggccatccgtgaaccagaaaaactgtcttctttcccttcggattataatcatatacagcaatacttacatcatccgatgcttttacaaaatacataatccaccattatacctttttgttatattatgcatttttttgaaagaggaatcatgtacttcctgttataatggtttttgtccgcgatttgtctcaggatatggagcaggcttttggagacgggttcgattcccgtcttccgcataaaaaaggtacgcagtattgccagccggtaaagctgttcaatattgcgtacccattttaaagtggagatgataaagcaaaatccgaacccctattaaagagttcggatttaggcttaataagtggagtagacgggagtcgaacccgtgtccaaaagcccattccctgtacttctactatcatagtcaattattaatcattccctccgataaccggaaattgacatccggttaacttcagtagcttcatgttacgcccacaggctcaaagctttgcctgtgtcgtttcctacaaattcgatgcctgggtcttaaagtgtaggtgctctaagtcagacaacgcagcattaagctgctgcgtaggctaaagtattgtcttcagcgtttatttttaggtttggatttaacgcattcctgcggatagcttctccagctgcaagacccctgtcgaaaccttgactaccccatattcaattgtaaacagtatcgttagtatacacatctttgtgcctgctgtcaagaagcggagactttaattaataaagatttttcactttaaattctctctccgactcccttctggcatcttttttggctatatcctgtctcttgtcatataactttttaccgcggcagagtcctatttccattttagcctttccatctttaaaataaacctggagaggcattaaggtataacctttttccgccaccttgcccgtaagcttcatgatctcagatttatgcatgagaagttttctcacacgaagcggatccttattgaatatattacccttttcataagggctgatatgcattccgtttataaatacttcacccttatcgatagcaataaaggcttccttgatgctgcatttgcccatgcggagtgattttacttccgtcccatgcagcacaagacccgcctcatacttttcatccacaaaaaaatcatgatatacttttttattgtttgctaccagcttcattgcttccttcgccatcgtcaatcccctcttcttcatatggcagtataaaatctatggttcttgtaaatctatctgcaaatttcacctttacccggagcttttcccctaatttataggttcttccggtctggcttcctctcatctcacaggcggcctcgtcatagtaataataatcacccggcagcatggatacatgaacaagcccttccacggtattgggaagttctacatacagcccccaggccgtcacgccggaaataactccctcgtatatttcaccgatatgcttttccatgaattcggtctttttcagcttatcggtctcccgttccgcttcatccgcccgtcgttccatctggctggactgttttgccacctgcgggagaatttgctcatagtgggttattctgctttccacaagccgcccgcggagctgttccttgattatacggtggatctgcaaatcgggataacgccttatgggagaggtaaagtgacagtaatactggcttgccagcccaaaatgtccggtacactcagtactgtattttgcctgcttcatactgcgcagggtcagtctgctgatcaatgcttcttccggtgttccttctatcttattcaacagcttctgaagctccatgggatggatttcttcctgtccggctttcatggaataaccgaaattatggatgaacagactcagccggtgtatcttttccggatccggattatcatggacgcggtaaacaaaaggcgcctgcagccagtaaaaatgctgggctaccgtttcattggcaagaagcatgaaatcttctatcagctttgtagctgtatttctttcgtaaggcctgatttccaggggatgtccctcttcgtccagaataattttactttcagggaaatcaaaatcaatagctcccctcttctgtcttctttttctgattatggaagacaaacgggccatatcccggaacatgggcaccagttccttatattcttcacactctttcggatcctgatcctcaattatcctggcaacgctggtatatgtcattctccggttcacatggattacactttccgccagccggtaatctgtcacttcgcctttgggattcaccgtcattaggcagctgagcgccagacgatcctcgcccgcattaagggaacagataccattggataatgcatggggaagcatgggtatgactctgtccacaagataaacgctggttccgcgtttcagggcttctctgtctaatgcggaattttcctgcacataattggaaacatccgcaatatggactcccaggcaataattgccgccctctctggtaaggctgaccgcatcatccagatccttggcatcctccccatctatcgtaaccattgttaaatcccttaaatccagtcttccttctctgtctgcctccgtaacctcaggggcacacctttccgcctgattcatcactttttcaggaaaagcttccggcagatcaaagttccttacaatggacataatatccacgccgggatcattaatatgtcccagaatttctaccacttttccttcggggctgcgtcttttcgctccgccgtaatccgttatttcaaccactaccttggaaccgctgacagcccccttggaacgctcctgggatacaaagatgtctgacggcagcttcgtattatccggaatgacaaaaccgaagttccggctcttctggtaggttcccaccacatgagtggtccctcttgcaaggatacggacaatctgcgcttcctgcctctgtccgtgacgttccggaaggattcgcacttccacagtgtccagatgatatgctccattcacctgatcctcggggatataaagatcctcttccctgccttcaatctgtacaaagccaaagcccttctgatggctggtaaaaactccggtaagcagctgctgctccggtttggaataccgtcctcttttattaatctgaatcttgccctctgtaagaagctcctgcagaattctttttaattccggcctgtcctccggatccacctgcataatacaggcgagctccttctctctcataggaacatagctgggctcttccataaagtcaagtatccgcattttacggatttctgttttattctgtgtcataattcctctgtttctcatatcaaataccccgcagcaagccgcgggtttaagcagcaggcagcataacagcttccggttcactgccaaaaaataagcacccctgtttgcatacaagagtgctttggtagttaaaatttggatatgttcaggatagccgcaataacaataaaggaaactgcaaggtacttggtaactctaaccagtgttccttccatggaacgtcccttgttctttccccagtatgtctctgctgcaccgctgatagctcccaggccggctgccttgccttcctgcatcagtaccaaaactgtcaatgcaatacaaattataataaaaagcaccgttaatattattctcaaaactgccatttctacacctcctaacaccgagcacttgtaagtttaccatagaaagcaaatatttacaatacaaattttttaaaaataagtgaataatttaaaaaataacccgtgcgctacaccagagcgcacaggctacttttattatacaaatattatttttctgttaataatccgcaggttatctaccaaactgcatatcattatttccggaatcggtttcccacatttccagcatattgataggatcgttgtagtctgccagccagccttcacgagcgaagtcaaactgtccctgctttctttcatcaaggaatacggaccactcacgggtctcaacagttacattgataccgatagctgcaagatcctgctgaatcgcttcaccaatcttaacattaccttcagaatcattggtaagataagtcatgctgataggagtttcagcggaaagcataccgctttcatcgaactggtatccggcgctttcaagaagagcctgaacttcttccatgttggcatctgtcatatccgtatcatagtaaccaaccttgtcttccagaggataggtgtaatcgccgtcattctttctgaattctccgccgtttccgtcagacattcctgtaggaatgaaggtatttgcaacttcctgctctgcctgtgcaattgtgtcaacaatgtactgacggtcaattaacagacacatagcttttctcattgcagcagcctgctcaacagtcttgcctgcaaacagatcgctgtttacattgaatccacagtaataggttcccagagtaggaatcttgtggaattcaggagtatcctttacagtagccatcatatcagtagcaatggtatctgcaaactgcagggaaccatctacgaatgcattgtaaattgctgtatcatcactgctcagcatgaattcgatcttgtcaagagtaactctgtcagcatcataataattagggttcttctcataggtcatggattcattgtgcttccatccggtacaaaccatcgggcctgaggatacgaaaccagcttctgtacaccatgcacccgggttatcagcatatccttcagctccttctacggaagcctggggaacaggatagaatgcagggaatgcacacaggtcaaggaagtatgcacagggagcaaccaggttaacgctgaatgtctttccgtcttcagaagcttcaatatccagagttccgtcatccttggtagcgattacggtggtcaggtatgcatagtcagcacctgtatcaggatttgcgagtctctgccaggtgtactcaacatcttttgcattcagctctgtgccgtcagaccacttcaggccatccttcattgtaaaggtatagctcaggccgtcttccgtcatctcatagctgtctgcgagatcgggaacaagctgtccgttctcatcatacataaacagaccggaaaatgccaggattgcaagacatgcgccgtctactgtagagttcagagccggatccagtttgttgggttcagatgcgatctgaagagccagtgtattggtcggagttgttgcataaccgaaatacttgaaaccgaaaaggtttgcataaatgccgtctacatcggttttctgaagataaacatcattgtagtagtaaagcggaataacagcccatgtgctcatcagctcatcttctgcttcatgcataagagcttcacgctttgcaagatctgtctctgttctgatagcagcgattcttgcgttgtattcttcccatgcgggtgctgcttcactggacgggccatgtgctgccgaacctgcgtctgcagttgttgattcttcagcgtttgcatctgctgaagattctgcggtggtttctgccggggctgccggtgactctgtagtgtttcctttggatccacatccagccagagtactcacaaccaatgaagcagccagcgctaatgctaagtactttttcttcataaattattacctcccatgaataaaatagatacggtttcttatacaatattcttcccttaaataagaagaacaaattgtatcaaattaaaagctgagggatttctgctacttattccagcaggcaacctgatgtccgttccctctgtctttcagactcggacactctttagcacactgctccgtagcgtatttgcagcgggtacggaatgaacagccgctcggcatatgcagcggactgggaacatccccctccagaacaatacgatgtctttcccgggccattttaggatccggataaggcactgcactgagaagagactgcgtataagggtgaatcggattgtcattcaattcattggaatcagcaatctcaacaattcttcccagatacattacagcaattctgtcggaaatatgatgaaccaccagcaagtcatgggcgataaacagatatgccacacccagcttatcctggagttcctcaaacatatttataacctgtgcctgaatggaaacatccagggcacttactgcctcatcacagacaatgaacttgggatcggttgcaagcgcccttgcaataccgatacgctgacgctgtccgccggaaaactcatgagcataacgagttgcatgctccgcattcaggcctaccagctccataagatttatgatcttatcacggcgttctcctctggaggaataaagcttatgcacatccagaggttctccgataatatcctcaattgtcatacggggattcagtgaagaataagggtcctggaataccatctgcatttcttttctcatatgcccgatggtggaaccatccactttttccccattgtaaaacacttctcctcccgtaggcgtataaagcctcagcagggaacgtcctaccgttgtcttgccgcagccggattctcccaccattcccagagtttcaccgggcttgatggcaaaggatacaccatctacagccttcagcggaatcgttttcataacaccgacttttataggaaaatactgtttcaggtcattgacctcaaccagatattcgcttttcttcgtttttgcctctttactcatgttttccgcctccttgctttgcctccatcgcttctttcacattcagccagcaggatgcgtaatgtccgtcaggcatctgcatttcctgaggaacttcttctatacagattttcatggcgttttcacaccgcggacagaaagcacagcctttgggcatattcagcaggttaataggcgtacccggaatagggatcagtttttccccgattttgtctacattcgggatcgaacgcagaaggcccttggtatattcatgatgagggcggtagaaaatatcttcagccgtacctctttcacacacacgtccgccgtacataacgataatttcatcgcacatatccgcgataacacccaggtcatgggtaactattataatagccattcccagcttcttctgcagatcctgcatcagttccagaatctgtgcctgaatggtaacatccagcgctgtagtaggttcatcggcaatcagtatgtccggttcgcaggccagagccatggcgatcataacacgctggcgcataccgcctgacaactcataaggatactgtttcacacgtttttccggttcattcacccctaccagagtgagcatttccacagcacgttcttcggctgcctttccctttctgtccgtgtgaagctcaattgcctccttcagctggtttccaaccgtgaatacaggattcaggctggtcatgggatcctggaaaatgatggaacagcatttcccgcggaattccctcatctgtttctcagaaaattttgtgatatcatcacccttataaaacacatggccgcctttaataccgccgttgctttcaaggatacgcataatggaataggctgtaactgatttaccggaaccggattctcctacaatacccaggatttttccgcggtccagatcaaaggaaataccgttgacagccattacctccccgttatctgttgaaaaggaggtacgaagttcttttaccgaaagtatactatcactcattttattacctccttaatttcggatcaaatgcatccctcagaccatctcccagcaggttaaatgccagtgtaatcagacagatcataagagccggaaagatcagtttgtagggataaacatttattcccgctctcgcagcatttgcaagggaaccaagggaaggcatgggtgcctgaacgcccagaccgataaaactcaggaaactttccgtaaaaatcgcggacggtatctgcagcgctgcggaaataatgataacgctgatacagttgggaagaatatgcttgcggataattcttccggacttcgcaccactgatctttgccgcaagcacatattcattctgcttgatggtaaggatctgtccacgtacaagtctggccatacctgtccagtaaagaaggccgaatacgataaacagggaaatcatattagtgcccagcttctgcagggccgggtattgatcaatgttcagaacctcccggagcactacggacagcagtactaccataagcatatccggaagagaatatataatatctacaatacgcatcataataaggtcagttttcccgccgaaataaccggatatactgccgtacaggacaccgataataagaacgatgatcgcggcaaatacacctacggtaagagaaactcttgttccgtatacaacacggacgaaataatcacgtcccatttcatctgttcccatgatatggggaaatacttcgccgccttcatcaataaaggcctgttctttctctgaatactggaacggagccatattggacgcggtcttatcacgcttgccattcacagaaatgatctgggaataggaataaggaaccacatggggcacgatcaaaatcatggcaacaatcaatatgagtacaacaatacttcccacagcaagcgggtttttcatcagcttgcgcatgccgtccctgaagaaagaaacggactcgctcatcacgtcctgctgcttcttctcttcatctgtcgctttttcaaatttctgtaaatctatctgtaagctcaaaggagactttttcggcatttcatctatatttttcttatccattactggcctcctcctaatcaagtttaatacgagggtctacaagcttgtagacgatatctgtcaaaagattcatagtaaccatcagcacggcaaggaaaattgtcgtacccatgatcatgggataatcacggttggtaataccatccacgaactttgccccgagtccgccgattgtgaaaattttctccacaacaagagaaccggtcaatatagatgccgtcataggtcccacataagtaataacaggaattaacgcattccttaaagtatgcttaaatataaccttccagcgggccacacccttcgctcttgccgtacgcacataatcctgccccattacgtccagcatactcgtcttggtcagacgggtgatgtatgccatcggataagccgccagcgcgataaccggaagaacataattctgatggttggcatcccataccggtatcagcttcagctgtacacagaataccagcagcagcaatgtggcaaacacaaagctgggcagggatgtaaacaaagtggaaaagaaaatgatcagacgatccgggagcttattcctggtcaaagccgccaggctgccgaacaccagaccaaaagcaagcgctacgagaattgccataccgccaagcttagctgatacatggaaggactcaaaaatcagagttttgatatcacggcctgttttggtggagataccaaaatcaccatgaagaagatttttcatataaatcacgaactgctcaggcacaggcttatccagattgtaccttctctccagtgcggccttaacctccgcagatactgccttctctccatcaaacggcccgcctggtatcgcattcatagcaaagaatgtgatgccgcagacaatcaaaatagtcactatagcgagaaggattctctttacaacgtattttgtcaactgaaacactccttttctgtttgtactggccattggcaatactgtgcaatgtaatccggtgacagcaatggctgtttaaagaaaaatgacctattatcccgttgtcctccgcagaaacacaagtatgattctcctgcggacatacaggcactaaacaatgacgcctggcgagccagccgtctcatgtctgcgtcagcccatagttccccacgaagctttaatgctgccatatctttctctgtttaacttttacacagatcatatcataccagctttacaaatataccacaatccgatggccgatgcaagatttttcagatttaaaacaagattttccaaaaaaatattccacaattgtacaaattgtggaacaggcccgtttttttgtataacaaaaaagaagtccggtatctgtgtgccgggcttctctttcttctattaaatataaccgttattccgggaccgtccgctaaattttgttgaaaggctctttataacatgcggcgtatcccagctcctcttcaattctcagaagctgattgtatttcgcaaccctgtcggtacggcagggagcgcctgttttaatctgtccggcgtttaccgcaacggcgatatccgctatcgtagtatcctctgtttctccggagcgatgggaaataattgttttgtatccatttttctgggccatgctgatcgcttcaaaggcttcggaaagcgtgccgatctgattgaccttaatcagtatggcattcgcaacacccagctttattcccgcatccagccttttggtattcgtgacaaacagatcatctcctaccagctgtactttatcccctaatcttgcggtgagcatcttccagccgtcccagtcatcctcaaaaagcccgtcttcgatggacaaaataggaaattcccgtaccagttcctcataatattccaccatggcttcggaatccctgtatacttcctggccgctcattctgctttctccggggaagtaataccgttttgatttttcatcatataattcactggcagctgcatcgatagctatcttgatatcctgtccgggggtatagccgctggcctttaccgcctccactatcagacgaaggacatcggaagagctgcccagattgggagcgaaaccgccttcatctcctactgctgtagaaagccctctgtccttgcagatcttcttcagattatgatagatttccgcacagatgcgtaagccgtcccggaaggattccgcctggaccggcatgatcatgaattcctggaggtctaccgtattatccgcatgctttcctccgttaaggatattcatcatggggacaggaagctgtcttgcatgaattcctcccagatactggtacagcggaatttccagtgctttggctgcagcctttgccactgccatggaaacgccaagcgtcgcattggctcccaagttgcttttgttgtccgttccgtccgcatccatcagaatacggtctatttccagctggcaaagagcattcttccctaacagcgccgccttcagcttcgtatttacatttttgacggccttctggacacccagtccaaaatatctggtctccccgtcacgcagttccaccgcttcaaactgtccggtggaagctccggatggaaccgccgcccttcctgtaaccgcattttccagtgttacttctgtttctaccgtaggatttcctctggaatccagaatttctctcgcatgtacgtccgtaatttccaaatataaatgcataccttcctctctttctgctgccgtctgacagccagtactatctctcatagtattttccgaaaaaggtatttttaacctgattattccgtttttgcagttgttttttctatcacgaacgcagggatgcgatccattatcggtacaaacccgacattggatgacgtaagtcccattccaggtttgaaggtaacactgatatcataattatcatcctgcagtctccctgttatgccggagccggaaatatccatcagggaacggggatataatgaaggacagattttctttatgtcctcttcatccgtaaaggtttcggtaataatctgttcattggaataactcaccgaacgcccgccatttttggaataaaaaacatcactttctttcagattatagcaggttacgctgacactgaccacccggccggcatccacaaaggcataatcttcagcaagttccttatatgcgccctgttccttcagaagagatatggtatcctcaaagtccggatataccggataagtccaggaataataattgccctccggctctccgtccacatgatatctgaagctcaggctgcccaccggcagctgattcatcatcatgctgcagctgtaatcatccagatcctcactcaaaaccttcagcagccggctcatatcccccagataggacacctcctccagcccgttgctgaaaacagctttcagaagatctgcattctccgtcatgacaggatcatttatctgataccggttatattggtaagaccggtctgcaaaaatggtatccatctcaggcagggactgttccagatccaccgcagcagccctgcataaagaacgcccgtttttcagattgtatttcagataaacgacaacattgctgtcatcataaaagttcatatccacttccttttcatgatctctggcagccagggtcctgatcgcttcaatcgtcctggtatcctcagattccatatgcgaaagcatatattcctcatgattgctgtaataaatgtttttttcaaacagcctttcataattgctgaagccataaatatcctgccggaaggtaaacgccacgctggcaatttcatccgtttccggtatatatgtgtcatatccggtaaaatcaaaatatacggcagagaatatcgcggctgcggcagctcctgcagcaagaatatgccattttttatttaatacggaatggatatcaaattcataaattatctgaatgagcccgtgactcagcagaaggccgataagcattcccaatacggtaaaaaacacactgtccccggaaagccctctgaaccacagccctgccagcagggtaaccggtatcatgagcagcagcttaatcacacttttgcttttcgtgaaggccatagccataccggcggcttccgcttttcttttccggtacagtacatatgccgctgttccataaaccagggcctgaacggctatcaccgcaagcttttccaggaagcttaccatgtatctgctcccgcttccccacagatagctggacatgtcactgattccgttcagatatgtaaatgcaggtgaggtccaggaattactggtcgtatttccaaaggaacaataggttctgaaaaaggcgctctgcattccgtccataaggaaacgtatcatgtattcatacaggagaaatacactgcagcccatcagggttacaagtacatttcccgtcagcatcaccgccatgatggaaagattgtaaacggctgtaaaaaacagcatattgcagaggaaaccgcctaacccaaacagtatggttttcacggaaaacgccccaagcactccccccaccgcaaaagcgagcagaagggcacagaaataacatactccatagattccgattccattcagataaatggtaatgtacctttttacggaagaaaccggcatactcatgtacatatccgtttttttacggctgtaaagccaggaaaatccctgaatggcaaacaatacggcaaaagcagccgttatgataagaagaacctggtcgaaggaaacggcattcatgaaattacgggctacccattccggtccgtcaaaaatgcccatataatagactgtgccattttccacattcttcctgtccacagaaatagccatagcctggcaaaccggcagcactaggaacatggacagcatacacagaagaacggtccagccccgtcttttcagattttcccttatcctaacccagaaggagttttttgatatcataaccggttacctccgtttcactgataaaaatttcttccagagacaaaggcaggacctcgtaaaagtaggtctccgccgcggcgaactgcgccaggatttcatctctgccccctcttacggtcagggtatgcagagagcctcttttttcttttttaactatatcaaggacagacagcagcttatcggcttcctcctctgaggaaaagacacactgcaccttctgtatattgcatttcatatcctccagttccctggaaagaagcacccctccgtgatggagaagacccacatggtcgcaaatatcctcaagctcgcgcaggttatgggaggcaattatgggagtcaggcctctccgctccatttcctgggcaaaaatacttttgattccctgtctcataaccggatccagcccgtcaaaggtctcgtcacagaataaatatttggttccggagcagatcccgcatataagggccagctgctttttcattcccttggagaaggtgtttatcttccgtctgctgtccagaccgaagttcgccagatacagataataggactctctgctgaatgccgcaaagacactgctgtagtatttctccatgtctctgggcgttgcattggaaaaaaagtaaggctcgtctccaatgaagaaaaacattttctttgcattaacattatcatatacctgcatgccatcaattaaaaccaggcctgcgtccggcttaagaactccggcaagcatacgcagcattgtactttttccagctccgttcgttccgattaaaccgaacacattttcctcttttacagaaaagcttacatgatccaccgctctggttttgccaaactgctttgatacatctttgatctcaatcatagcaaaaatcctccccggaagttacatgcaggaccttctcctgccgttccttcaaataagccgacagttcctgccggcttatccctatttcaccggcctccctgacaatttcctccagttttctgtatatttcatccttacggtaacgcagaaggctttcgtcataagccacaaaattccccctgccctttaccgtatatataaagccttctctttccagttctgaataagcccgctgtatcgtgtttggattgatggaaagctccaccgccagactcctgaccgagggcatcttggtatttggttccaatgcgcctgtaaggataagcttctggaacttgtccaccacctgctcatatattggcctggcatccttataatcaagtataatcataggactcctttctgcatgtaaatgctgtgtcaagtgtactaattatactggtacacttaatgtaccacattcaggcaattatagcaataatttgttacagaattgttacaaaaaaaggaaatcttcgctttttttagacaaaagcaaagatttcctttcctggatttattccgaattcaaaattctttatttcttaatcagcagggactttcctgtcatttccgcaggctgttcttttcctataacctgaatcagggtaggaataatatcagccaggcatccgccttctctcagactataggcaggatcgtaattcacaaggataaaaggcacctgattcgtcgtatgtgcggtaaaaggcgcaccggtttcgtaatccaccagctgctccgcattgccgtgatccgcacagataaacattacgccgtccacgctcttcaccgcttccactgccttgccgacgcattcatccacggcttccactgccttgattgcagcgccttccacaccggtatggccaaccatatccggattggcaaaattaatgataatcacatcgtatttatcggacttgatggcttccaccagtttgccgcatacctcatatgcgctcatttccggcttcagatcataggtagcgaccttgggggaattcacgaggattctttcctcccctttattgggagtctccacgccgccgttaaagaaaaatgtaacatgggcatatttttctgtttccgcaattcgggcctgggtcatattattatcagccagccactcaccgaaggtattggtgatatccaccttgtggaaagctacttccttgttgggaatggtgggatcatactctgaaaagcagacatatgtgatatccagtctcttatcccttgcaaagccgctgaaatcatcatcacagaaagcatgggtaatttccctcgcacggtccgggcggaaattaaagaagataatggagtccttatcctgaaccgttgccaaaggcgcgccgtctcttgttactacggtaggtttcacgaattcatccgtttcatttctgtcataggaagcctggatcccttccgggccgctctgggctgtcaggccttcacccttagtcaaggcatcatatgcaagcttcacacggtcataattattatctctgtccatggcgtaataacgtcccataacggaggctacttcaccaacgccgatttctttcattttcgcttccagctgctccacatatcccttgccgctggacggaggcgtatcacggccatccaggaagcaatgtacatataccttcttaaggccattccgctttgccagttccagtaagccgtaaatatgagtaatgtggctgtggacaccgccgtcggatacgaggccgtacagatgaagagaggaatcattctttttgcagttggcaaccgcatccagcagcgccggattttcaaagaaagtgccgtcctgtatttctttcgtaattcttgtcagctcctgatatacgatacggccggcacccatgttcagatgccctacctcggaatttcccatctgtccgtcaggaagtcctaccgccatcccgcttgcatttccctttacaaaaggatactctgccatcagcttgtccatgacaggcgtctttgcttctgccacagcgtttccttcttttttgtcgttcaggccatagccgtcaagaatcattaatactactggtttcttgctcatctttttctcctttttctaccatataaaaatgtaaatgttacatcctgataactgttataataagaccgtcggctgcacgcttccggctcattcctctgaaattatacacgttttccgccaaaggcgcaatacgtttttgcccgcaggaataattgacgacggggattgtaatttccggaagaaatgttaaaatgaggaataccggaaacggattatttttattattatttattgtacataggaggttatcatatggtgcgtcttcttgcacgtatattaataaaggattatgatcagacagagcagcccgctgtcagacaggcctatgggatcctgtgcggcgggatcggaattgcctttaatattttattgttcgcagggaaatttttagccgggtccatcagcaggtccatagccattaccgcggatgccttcaacaacctttccgatgccggttcctccctgctcacactgatcggatttaaaatggccgggcagaagccggatacggagcatcccttcggccatggaagaatcgaatatctcacagggctgctggtttcccttttgatcctgctgatgggatttgagcttgtaaagtcttcctttcttaaaatcctgcacccggaggatacggaatgcactcccctggttattatcatcctgcttgtatccatcgctgtcaaattctatatgttcctgtacaaccgctcaacagggaaggaaatcgccagttccgccatgctggcaacagcgacggacagtttcagcgacatgctctccacagccgttgtgctcgcagcaaccctgattggcaaatttaccggccttcatatcgatggctggtgcggccttttggtaggtatcttcatactctatgccggtttttccgccgcgaaagataccatcagccccctgcttggacagcctcctgagaaagcctttgtaaaacggattgaatccattgtgctcagcaatcccaacgtcctcggaatccatgatctggtcgtacacgattacggaccgggccgggtaatgatatccctgcatgcggaggttcccgcctcgggagacatgcttcatctgcatgacgccatagacaatatcgaacgcgatctgaaccgggagctccactgtgaggcggtcattcatatggatcctgttatgaatgatgacgcccagacacaggagctgaaagaaaaagccactgtttttctccatgaactggacgcttctctcaacctgcatgatttccgtatcgttaaagggcccacacataccaatatcatatttgatattcttgtccccttccacttccaatacagcgattccgaaatcacctcttttatggaagagaaaatacgcggcctggatccctcctattatgctgtaataaatctggatcgggattatactacataattataaaaagggaattgacaaaacacacggcaccgtggtaaggtataagtactctgtaaccgaaacaaatattaagaaaaggaggtaaaacctatgtcgaacggaaacagaaagatcactgcagcatcggacaatgagaacagactggggattgcctcttggtattacagcgcttcgctcactttctaagatcttacgggattttataccgtatttcttattcataaagggctaaggcggcattttaccacgacaggtaattctggcgtggtttttttgtggaaatacatccctctgcctgttggcagggacatttccaaaggccgttttactgccttcaccacgccgggaagcatattctgcttcctctttcttttctttcattttcccggtttacaatcttacataagggggatctatcacaattatgaaaaagttatccagttacttaatggaacacaaattcggttatcttctcggattcgtttccatggtaatcgccgtatccttagatatggtgtcaccacagctcacaaagcatattatcgatgatgttatcgtaggcgggcggattgaaatcctgaaatacctgctgggcggcatccttattgtgggcgccggccgctgtgtgttcggctataccaaagagttcacttttgaccggattggctcttccatcgcaactgatatgcgaaaggaccttttttcccatatacagtctctgagcgcggattattttgacaaaaccaacaccggagaactgatgtcccgcgtcaaggatgatatcgaccgaatctggaatgcggtcagttatgtgagcatgctcatccttgaagtggttttccataccggcatcgtgcttttctgtatgtaccgcctgaattggaagctggcgctgattcctaccgccgccatgctgatcaccggtaccattgccattcttgaggaacgccgtctgggagttatttatgaagatatcagcgaagaaaacgccgttcttaatacggtggcagaggaaaatctggccggtgtgcgtaccgttaaggcctttgcgagggaaaaatttgaaatcggaaagtttctgtctcacaataaccgttattatgaactgaatatgcgtcagtccaaggtttttgtaaaatattatccttacttttccctgataacaaagcttcttccactgatcattctgtttttcggaggcgggctggtcattcagggcaagctgagtatcggaagcctgagcgcctttgtggaatattccatgaacatcgtatggcccatggaaatgctgggctggctttccaatgacttctcctctgccgtaggaagctaccgcaaaatcagaaaaatatataatgtaaagccttctatctcggaacctgaggttcctgaaatacttcccgcagtgaaagggaaggtggaattcagaaatgtgtcctttcataaggaagacggctatgaaatccttcatgatatctctttctgtgtgcagcccggcaataccatcggcattatgggagccacaggcgcgggaaagacctctatcatccagctgctgcagcgtttgtatgacgctacagacggaaatgtttatgtggatgacgttgacatccgtaatttatccttaaaacagctgagaagcaatatctctcttgtcatgcaggatgttttcctcttttccgacacaatcagcgaaaatgtaaagctgggaaaaaggggtatggtggacgcatcgacaatacgcggggcttccgcctgcgcccaggccagtgaattcattgaaaagctggatgaacaatatgaaacggtgatcggggagcggggagtcggcctttccggcggacagaagcagcgtatcagcatcgcccgcgccatcgccaagaaaaatccgattctggtcctggatgattccacaagcgctctggatatggaaacggaatacgctatccagcaggcgctgctggaacttaccgataccacaaaactgattattgcccatcgtatcagcgcggtccgcaacgcggatgagatcatcgtgctggaaaacggttctattaaggaaagaggaacacatgaaagccttctttcccagaaggggctttactatgaaacctggcaggcacaatatggtgtgctcggcaccggccaggaaagaaaggaggcgtaaaaacatgcctgttaattcttacagagatgacgaaaaaactatagaagtcgggaaaatggccacattgggacgcctctttaaatatctgctcgcctataagctgcagatcgtaggtgttttgtttatcatggggttctgtgttgttgtaaccctgttaaatcctctgatcatggaatccgcggtggatgattatatcaccgcgggggattttacgggactggggcgactgatcctatttgccattgtcctgaacctgattatggtcctgggaatcaagcttcgtatgtatgtgatggcaaaagtatgcaacagcatccttgtcaccatccgccaggagctgtatacccatatccaaaccctggatttccaattctttgacagccgtcccacaggaaaaattctcgcccgtattatcggcgacatcaactccctgaaggatgtactgtccaattgtgtcaccactctgatcccggattttatcaccatctgcgcggtagtggcaattatgtttgtaaaaagcccggggctggcggcggcctccatggtcagtcttcctttaatggcggtctgcatctggtatatccagacacgctctcataaaagatggcagatccaccggaaaaaatcttccaacctgaatgcttttgtccacgaagatctgtccggtatccggatcatccagagcttcggggccgaagaagaaaccatggaaaccttccgggagctgacaaaggagcacagggattcctttatccatgcggtccgcctgaatgacgctatcggttctgtcatcgatttctgctggggcctgggaattgtttccctttattttacaggcattatcataatcggagtggataaggtatccatcggtaccttcatcgcattcggaacctatatttccatgttctggcatcctattatgaacctgagtaatttctataatcagatgattaccaatatagcgggtgcggaacgagtatttgaaatcatggataccccctctgctatcaccgatcaggatggagtgagggagcttccacagattcagggagatgtggtttttgataaggttactttctcctatgacggcacagctaaaatattgaatcaggtaagcttccacatcaatccgggagaaaccattgcgctggtcggccccacaggagccggcaaaaccactattgtcaatctgatcagccgtttctacgacattcaggaaggccatgtttatattgacggctacgatgtcagagaggtatctatcgaaagcctgcggcatcagatgggcattatgacccaggataacttcctgttctcaggaaccattaaggataacatccgttacggaaaactggatgccacggacgaagaaatcatcgccgcggccaaagccgtgaatgcccatgatttcatcatgaaactggataaaggctatgataccctcttaagtgaaagaggcggcggcctgtccatcggccagaaacagctgcttgcatttgcccggaccatggtatcagatccccgcattctgatactggatgaagcaacctccagtatcgacacgaaaacagaacttctggtacagtccggcatcgaaaatctgctgaaaggccgtacttcctttgtaatagcccacaggctttccactatccagaaggcagaccgtatctttgtcattgataacggcaccattgtggaagaaggaaacgcagcttcgctgatggccagaaaaggggcttattatcagctatatatgagccagttcaaaaatgttatctaacaggaaaacataacatgtgcccgccgggcacacaaaaaagcggccttctgtcattttatccgacggaaggctgctttttcattcttttctgattccgttctttcacccgtatctgcagttcggtgacaaattcctccgttttcattgtgtatcggttatcaaccggatacagctccagaatatcccccattatctctaatcctctgcgggaagcttcttccagcagcgccagcgccctctgcggcgactgtcggtattccccccgataaaaggtactcaaataggtcccttccgacaaaagaaaatcatacccttcctgagaaacaccctctctcaattgcactttgccttccccgcactccccatcccgaagaataaaaaacacggaatgaaacagattataaacaccatttctcacatcctcaggagaaaggctggctccgaaattctgatcccctatactgcgtattttgtcttcatgccttttctgcagcctttttatggcgaaatcaacctcttcatccctcgttatatcctcatccagccgcagacaatatctgtcgggacaacatatcagacgataaaaattttcttctgttcccctgtatttctgaatgtgctccattcttctctctatggatttttccacaagcctcagctgttcctgctgctcccggatagttttcttttcatcctccagcatacggagtgtattttccagattcatatcatcaagatatgcctttacctgtttcatggaaaagcccagctgaagcaaatcccgaatcgtatttaaccggcagatatccttcagacgatacaaacgataattattctttccccgcttcggctcaagagctccaatctcttcataataacgaagagaatccgttccgattccatacaattttgaaatctcactgatggtataataatccttcatgttaccactcccctcttctccctttaaaatgaggtattaaagcattcatgtataaaaataacaggtaaaaattcaaaaaatcattgaccttagtattataccagagtttataatctttttgcacccaaaaattacgtaccgggtgcagataaaaaaagtgagtgccgccgtccgtgtcccggatgccctccgacgcggcccggcttcctcacggcccttatccccggtacgagccgccgccctgcaaggattcctctcaggggcgttataagctcgccggtccttaggctgcgtattttgcagccttagagcgtgtttaaaaattgctttctgcaagatgtgcgttacagtttgtggggaatatgttccaaattcatgaggcgtagcgggctacgttgattgaatttggaacatattccacgcaaagtggggcgtgcagattgcgggaatgaattttcaaacacgctctagtaccgctgcgtgattatccgagcggaagcgtcccctgtaaggaaccttgcagggcggcggctcgtaccggggataagggccgtgaggaagccgggccgcgtcggagggcatccgggacacggacggcggcactcactttttttatctgcaccttcacacccccgctcaagacccgcaaaaataaaagacagaaacgaggttttactttgcacacacttttacaaaagaattacaggaaaccccttaaaaccctaaaggatattttccctctgaaaactgttttatccattctggccggaaccgcaattctggccttcggcatggtgaatatccataaacgcgtccacataacagagggcggcgtccttggcatgattctgctgctcaactactggttcgccatacctgccgccctgctgtctcctctgctggacgccctatgctatcttttcggcttccggtatctgggcagagaatttctcatccgatccatcgccgcaacactatgccttgccggcttcctgaagctgtgggaaagcctgcctttctttcttcccgacctgacctcccgcccgctcctggccgccgttgccggagcctgtttcgtaggaatcggcgtgggtcttgtggtcaggcagaaggcctccagcggaggggacgatgccctggcaatggttatcgccaaactcacccactgtaaaatagcccgggcctatctggcaaccgacataacggtgctcattctctccctgacttatataccgcttggcaggattgcttattccttcgttaccgtaaccatttcctctctgctcattgactttatccaggacttcagcatagaggcatggaaaaagaagctttcatgcctcgccgccgggaaacagcccctgcccgggccggaggattcggaataagccctgcaagacggaactttcagactaagcctctgccgaacctgcgcaagcccagggtaaacagtatgatacatgccgccgctgtcaccacaggcacaagcggtatataccctccggcaaaccattgttcctcccatggcttcttatacatctgaaaaccggacagaaccgccggactaaaggaaaaaattctcgcggcaagcggtatccccgccctgtcgccccagtcaaacagaatccctcccgcgaagtatgaaattcccaatatactcacagctttgaacggcgtatccgaaaaagcggaaatacagtaagctccgcccgctatgagcagaagggaacagcctcctgttaagacagccgctgctgttgccgttcccagcgttaccgtaagtgtggtatccagccatactgctgccggctgtcccaggccggcgtaccagtttcccgctccccatacacaacagacgaatataagatccgccgcaagaaaactgatataaaccgccagcgctatggtgagcgccgccgctgccttacaccaggctgtttcttttcttccttttacggatgtccacagcagcccttccatattgcagctgtattcttcggcaaatacaggagaggtaaacagcatggccagcagcgccgcaaacagcccgtgtactcccaggagcagcaaggcggcagccgcaccctctcccatgctgtaatccgcctggtcagcatacatccaccataaaacaaacgtaaatacagcgcatccggaaaccgcggcgaaatgcagcggttttttcattatcttttccagttcaaacagatataatctcattttccgtactcctttcggtttcggcaccagccgctgtaaaccatccataagcccgccagacagaaaagcatggccacgactgcctgtaatatccaaaatgccttcctgccatcttcataaagaggtatcatcatataaaagggcattccattaaccagtaaagaaaaaagaggcgtgaggaacgtacgtatccacagcatttttctgataacaggaaaagcgaacaggagggccgaaaggcacacggaagttaaggatctgccgcaataagcggaaataccggacaggaaaaacacgagtactgtgatacccaatacggcacggggcagacaggctccggcccaaaaagctcccacagttaccgattccggccatatataaggcatggcgcccagacagagcatatttgccttaagcccttcaaagccatatatcaatccgcatataagaaagaaaagcccccctataagtaaataaccgcctgcagccacaatccaggaggcggcgagccgggcaactaccatcttgcgccttccctccgcactcgcccgtatcaccggagccgtccgaagcattctatcggaagaatacacaggagacagcaaaacaaccagagtgatcccccagaccacggctaatcccatgaaaatctcccacagctcatcccagccttccgtataggcaaaataaatatggtccttataggtacaggctcccagccagccatctttcgccgacaagggaatcagtctttccgctcttcttttatccccgctgtaatccgtcattttttccgtaacaaagcgattcaggaagtttccgtatacacagcctcccgcctcatcataacgggcaaaaccgaaacggctgataatggcttccgtcttttcctccgtcagatacccttcatattcagccgcaaggcgccggttatatgcagctgccttcagacctgaaatcgtgccctccccggtatataccatcggcagcatggaccaggtaaggaaaacaccgaccagcatggaaacagcaaaaccaatccacagggccggccgtttccataatttttccagttctgtgcccagcagcatcattctgcctcctccctgaaataatacagataaacgtcctccagtacaggttccacacacaccgccccgggtgcaggagaatcttgcgcaaggatgcgcatggctaccttatctccctgatttttcaggttgctcaccgcataaagcccgttcagccgctgtgcgccggcatgatccgtcacaagctcccatacccgcccctgaacctgcttcgtaatattttccacactcccctgctgcaggaatctgccttttttcatcaggaggatctcatccgcaatatattccacatcagatactatatgggtggacaggataacgattctgtctttggaaaaagaactgataatattccggaagcggatacgttccttgggatccaggcctgctgtgggttcatccaggataaggatttccggatcattcagcatcgcctgcgcgattcccagacggcgtaccattcctcctgaaaaagtcttgattttcttatttttactgtcctccagccctaccatggccaacagctccgcggtcttccttttcgcttccaatgacggaagcgccttcagcgccgccatatataaaaggaaccgttctgcggtaaaatcgggataaaatccgaaatcctgcgggagatagcccaaaaagcgccggtatgaggctcccagccgattaatcgggttccgatccagaaggatttccccctcgtcgggtctcagaatatcacacataagccggagcagcgttgtttttcccgcaccgttagctcccagcagcccgtatacgccatgggtgaaaacagcttccacatggtctaccgcgcatagatccttatatttttttgtcacctggtttaatgtcagttccagcatattttttctcctctatccaattctttggtcagataaatcatctgcgcagccatgagtgcagcggcccccagaagaacggccgcccacagtccgacagcggcttttccatacagtcccggaaacagcatcggcagaaaagagagaaagcccgctgccagaagaacgcttacctgaaaaagtttccttcctgaacgcataaaggtaaacgcagtaaaaaacagcagcatattgcacacatacggcgtcatcagataaaggcttatccgaatcagccccgcctgcagcctgccctgggatattcctataaagcagcccagaaaaagaagattcaccgctccggtaatcgccatcctcaccatcatcagctgacgaaggttcaaataacagctctgctccagttccgccatgcggcaggaaaaacatttggcaagctctccgaagcctgttattcctgtcagcgccagcagggcggacaaaacaggaagcaaaaacatctccggactgattccggcctctgtcagcaggctttccgggccatacaggctatccgccctgccggacagccatattcccacacagagcagcacagcctgcagataccagtaattaacggatattaaggacagctcattccggaaaatctccggcagagaaggcctgcagcacactttctttctcccggcttccagacggattgcctgcagtgcagcagctttccgaacaggatccgccacgggtccttctccgaagagctgtcttccctcctgtctggtccattcctttttcgtctgctgtttcagtttcctattacccatctgtcaggcctcctccaaatatttcttaagcttaagcttcccctgatgcagcctggactttaccgttgccgcatttgtttccgtaatccgggctatttcccgtatgctgagttcatcataataatacaggattaaggcttccctctgcatttcaggcaaagacgtaagcgctgaaagcagtgtctcctggtattgtgactcgtctgtctgttcttccctgctttcttcctccgccctggccagctgtcccttcataaattcctgttccctggccgcccgcttaaaatagtcacggcagacatttctggctatcgtaagcagatagcccttcagatttctgtccctgtaactgtccgtatagcggataaaccggatgaaggtttcctgggcgcagtcataggcatcctccgtactgcctgtctgatagcagcagaaccggtagatgtcgtcataatatttttccgccgcctcttccggcagcagactgtttcctttatgtattcctttggtttttcctgttttatccacgaaagaggccccttttgtgttattgattgcagcgttcggaaccgttgcaccttatataactgttttgggagaaaaaaggttttaaaaaagcagaagattttctctcctgcttttttaagcttatcaaataacaattctgccgtttccattcagttccagtctatcataatcagcagcgtgccattttccacagtgacactgctttcctttccgataaattcattgcttaccccaatcgggaaatcattggtgacaaccgccttatcaagaagatacttcatgttggtgatagtgacgccttccgccttttcccccagagaaaacaaagacaggaagccttccaggttcttcttaaaacgcacggtttcatttttggccaccagaatcatgccgtttccgtccatcagatatcctttcgcccctttttccttcaggtaattaagacactgtatattggccatggtatgggcgagccggcctccctggcctccatagatgacaaattcctcaaagcctttattcaggccttctttaatagctgccagcatatcagtatcatccttctccacaggcagtaccttcaccttttccgggtaacgggcgcgcatttccatgatatcttccatattgcgctcatccacagagtcaaaatcccccaggatcaaatccggttctatctccagatatctgcaataggaaaaaccgccgtccgctgcaattacataatcgccttcatgaagcgggatctccgaaacactcaggtcccccgcaccgataatcacacatcttcctgccatagttattctccttttctttttatccggctagttcaccagactctttttactccattttccggtaaggtatctgcataaagaaatcatataattaatggcccatcccgccggtaccgcataccataccgccgctaccccgactacaggcgcaaaaaggaatgcacccagaacccggacagccaggttggccagattagctagtgtaaacaccatcacatctcccgctccccgcaggactccgtccgtaatcgccttcaggccgataaagataaagaaaaatttcataaaggataaatatcccgttccggtagcaaatgccgtcccgccgctctggctgttcataaaggctccgataatctgcttatcaaagaaaaacagaatcagtccaatcagcagtgcaaagcctccggtaattgcatatgccgcccggtatcccctgcgcacacgctccggcctgcccgcccccatattctgggctgtgaaggtagacatggcgtttcctgtggatatcatgggcacgatacaaatggattctatccttgtactggccgcatagcctgccagaaccgaagacccgaatccgtttaccacagactgtaccagcagcagcccgatggaaacaatggattgctgcagaatagacggaagcgctatttttaccatggatttcaaaattcccacatcatatttgggcactgcctcttccgtctcaaacccgttcagacgatgcatcagcagcaaaaacgaaatcactgccgccgtcccctgggcgataaccgtggcgatcgccacccctgccacacccattccgaactgcagtacgaaccacagatccagaaacacgttcagcacagaagaaaaaatgagcagaaataaaggcgtcctggaatctcccaatgagttgaacatggaagaaagaatattatacatgaacaaaaacggcattcccaaaaaataaattcccagataggtgcctgccgccgctatgatattatccggtgtatgcagccacagcaggatctgccggttcatcaggaagccgaaaattcccagcaggcttccaaccgccaggaaggtcagaagagccgtataaaccgaggttttcattttttccgtatcaccggcgcccaggtactgcgacgttattacggaagctcccattcctcctcctatggcaatcataacaaacacgttggtcagcgcataagaagcacccaccgccgcgagagcattttctcccacaaactgtcccacaatcatggaatccaccatattataaaactgctggaacagattgcctaaaatcaaagggagagcaaagaggaaaagcgcaattcccggagttccctccagcatgctccatttttgagattttcttttttccattctttttccatcctcgtgccggggattccttcctttctcttttttatcacgatccccaaaaacacttcccaggatacatcctttacatacattcttatctattgtagcaattttttcccaaaatgaaaagattttgtgataaaatctataattgtatattttcctagttacaattcacggcccggtgttgccgactttatggttctgcccgcccgatattccctgccctaagacagaaaacgaggttattatgcttacttttcctgctgacatgaccgtttcccagaaacaggcctttgaaaaaagataccgccaggcggcggcatcctattttcccatgagagtgtcttactatcatcaatttacaggcggcacctacagccgcatcaccatacgcgggcagcacacccgctggggcagctgttccagccgcgggaccctttcctttaactggcgcctgatgatggcccctcccaaggtgctggattacgttgttgtccatgaattatgccatttgaagcatatggatcattcccggaatttctggaatgcggtggctgaagtaatgcctgattataaagaacagaaaaaatggctgaaggagcatgggatggaattatttgttctggctacctgattcagggcactcctttatcttatccaccttcacctcttcctttatgccttcctgctttaccgcatacatatggttaagcggcccattgccttttcccaggtcaagcttagccttcagtgcgccgttcagatattctttcgcccgctttatgctctcctccgggctttttccttccgccagatgacaggccgcggcagatgacagggtgcagcctgtaccgtgagtgttgggattatctatccggggagaggaaaagcgggtataacagccgtcccggaacagaatatccgccgcgtcactctcccggtgtccgcctttcaccaatacagcagctcctgtccgaagggcaagctctttagccgcctttttcatatcctcttctgttttgacagacaaaccggtaagaatctccgcttcagggatattgggagtgatgagagttcccatgggcagcaattttgcttccataagcttcagcgcccgggaagaaagcagctcccggccgctggtggataccataaccggatcgattacgatattaccgggccggtattgcttcagcttatgtatgattacttccaatatttcttccccggataccatgccgatttttacggcatcgggaaaaatatcggaaaatacacaatccagctgggcagctataaaatccggctccacattggaaatcgcatatactcctgtggtgttctgtgcggtcagtgaggttataacggcgctggcataaaggccatgtaccgttatagtctttatatccgcctgtatacctgccccgccgctgggatcagagcccgctatcgtaagaacttttttcattcagataactctccatttcattaaatgaccggaaatagaagtcagagatctcccggatctccggttcctccttttctgctgacggatcataaacagccgccaccaggaaaccgtcctctttcgctgtcttaacagcatacaaggcatcttcaattacaatggtatcctcttttgctgttccgagaagctgcccggccttacggaagataaccggctcatcctttcccgcgcccacatccgtgcaggtgaggacagcctcaaaataatctctgattccgtttctctcaagtgccttttcaatcagccctttgtccgtagccgtcgccacacacatctttacgtttttctgcttcagcttgtccagaaccgttttcacgccttccttcagcttcacctcattgatgtaaaaggacgccgctattccattaatatcctctataatcttgtcttctgcatccgcaatcccataagcagtctgaaaatagaccgcagcctgaggaagactcatattttttattgtttccctgatgttcttttccggaacaataccctttttccgcagatatttttcacccagagtatcccaaacggacatggaatccagcagggttccgtccgcatcaaaaatagcccctttccttttcagtctctctgccaggacccgcagctccctgcattccttctgtatgcagggactggaaaagatggccgacaccaaagccaccccatcgattcccgtatcctgcagcaaatgcatatttcctttgtgtatccctccgattgcacagacgggtacggacaccgcccggcagatttcccggagggtatccagggaaacctcctgtgcgtccgttttcgtggaagtggaaaacacagcgcccacaccaaggtaatccgctccctttttttcggcttccactgcctgttccacagtctggactgatacgcccagcagcatgccgtctccgattttccggcggaccgcgcctgcctccatatcatgctgtcccacatgcaccccgtccgcgccgcagcgtacggccagctccacatcatcgtcaattataaaagggatcccatatttatgacaaagtctttttatactctccgcttcttccaggaactgctcctttggcatatccttttcacgaagctggacacaggtcacacctcctgccagcgcttcctcgacctgcataagcagtgtcttttctcctgtccaggcccgatcggtcaccgcataaagaagcattgtctttctgtcacatttcatggctgtcctccccggaagcaggcttcatcccatccttttcccatatatatttccgtatatccgcctctttttccagcgtttccccgtccatatgatatacggcgtcaataatatgattccggtaggcagcattgccttcctgcggtgtgagcctcttataggcctgttcccctgcgattcccatggcacataccgctgctgcggccgcttccaggggatggtcaggatttgccgtaagataagccgtcatcatggcggacagcatacagccggtacctgttaccttgctcatcatgggatggccgttgcttatgacaaaagcctccctgccgtccgtcacaatatccaccgcaccggtaatcgctgccacggccccggtcctttgggcaaattctgcggcaaatgtgactgccgcctccagcgtggcatccgtcaccgcgtccgtactgtccgcatccactcctttggtcgtccccattcccagagccagggttttgatttcggaaatattcccccggatcgctgtaaattttacttctttcagcaattcctccgccgtttccgtccgcaggcggctggccccggctccaaccggatccagaagcataggatgcccgcaggcgttcgctttttttccggccgccttcatggctggaatggtgcgctgattcagtgtcccgatattgatatgcaggcctccgcatatggatgtaatttcctccacttcctgcagttcatcggacatgataggtgaaccgccgcaggcaagcagaatattggcacagtcatttaccgtaacacagttcgtaatattatggatcaggggtgtccgttcccttactctttccaccaaaacagccagttccttttgttccttcttcatttatcccatcctcccttttactcttcaaaaatagatacgatctcgccgtcaagaatccggttcatatttttcaccgcacagaaattgccgcacatgctgcaggtatcctctttttccggcatggatgtttcccggtatctttccgccttttccggatccatggccaaccggaacatttccttccagtccagcttctttctcgccgcgctcatagaattatcccattccatggcatccggaaccccttttgcgatatccgctgcatgggcggcgatcctggcggcgataatcccctccttcacgtcctccacatccggaagacgcagatgctcggcaggggtcacatagcacagaaacgaggcccccgcagcagcagcagcagcgccgccaatcgcggcggtaatgtgatcgtaccccggggcgacatcagtcactatcggccccagcacataaaaaggtgcgccatgacagagagtcttctggatttccatgttcgcggcgatctgattcagcggcatatgtccggggccctccaccataacctgaaccgcttttttccacgctctttccgtcaattctcccagagtgatcagttcttctatctgggaggcatccgtagcatccgcgagacagccgggacggcaggcatcccccagactcaaagtcacgtcatattcccggcagatttccagtatttcatcgaagaattcgtaaaaaggattttcctcccccgtcatttccatccaggcaaatatgatggaaccgcctctggaaacaatatttgtcagccttttgttcttcttgaacttatgtgctgtttcccgattaatgccgcaatggattgtcatgaagtccactccgtcctccgcatgcatcctgacaatatcgatccattccctggcggtaatctgcttcagcggcttatgataataaaccaccgcgtcataaatgggaaccgtaccgatcatggccggacaattctccgtaaggtaccttctaaacttccgggtatccccgaaggaactcagatccataatggcctccgcccccatttccacagccctgtgtaccttttcatactccatctccaaatctgtcatgtctctggaggttcccagattcacgttgattttagtcttcagcatagaaccaagtccgttcggttccagcgatttgtgccgcttattgcagggaatgattacctttccttccgccataaggcttacaagctgtgctgcaggaattttttcttttgccgcaacggcattcatttcttcggtgagaatccccctgcgtgcagcttccatctgtgttgcataattcatccttattccttctttcctgtccggggacttgtctgtcgggaatgcctgtgtatttctgcccggaagccatcggccgcccttccgggcaggactcctttcatacgcaaaaaaacggagcatacccatataggtatactccgccgataagctgatttctcacttcttcctacgttggcattacccaaatcaggtttaagggtcgaagttggattacttcctctcagcctgctcacaagctcccctgaacatatgtattttacaactccggaatgatccgattgttgtttctgctggaaatcatatcacgattgccattctttgtcaaatgtgcttgaaaagtactacttcattcctgtatttacttgtccaactctaaaattcccatctggaataaagccagtgtcaacatagaaaataaccggaagccgccacctaataaatagttggcttcctgctttgtgaatacagcaaaactcgcaggtgcaaagtcatcaatatcccatgtaatttcctctgccgtcagataactcatgaactcgtatgctgcttttattaacgttttatcagaaattttattaagctgaatctgtttattttttccgatgtaattttttacttccttgcccaaaccaaaatacagatttatggtttcatctataaagttagaaactataaaactttcaatgctcggatagctcaacagcaactgtcccgcctgctccccatcttcattgtcatagggatttgcaagtattttaatatacttttcaatcagttctatatttgtattcgattcaggatctctgtcaaataaataataaatggccgaccgttccaccggaaaatgatattgttctctcaacacatcaaacacatcatccagatacttcggattctcactaatatcccgaatattgctttccctcgtatttacaacagccacttttgaatagggatcgctgtcttttacatagtaatcaggcgtatttcgcttctttgcaacatagctatatcccaagagtccgcagaatatcttatacagataattgaattctgtactgctgccttctacgataaacagaacctgaccgattcgtttctctttgttaattctcatccgccacctcatgatacaaaggaataccgccaaacactccactcacatacatcttttccacattttgagcagaacgcggctgatccgatgaaattctatgaatagaactcccttcattaccatgaaactccacagtatactcctgatccggccggagaatagaattcgacaaaagattcgtagaatgcgatacaaaaatcatctgtgcattttttgatttttgcataaagtagcgtaccatcagactttccagctgattgtgaaagccactggagaactcatcgatcagaagcattcccccttttttaagaacatacaaaaaggccggcagcaaccggagcagattctggtttcccatggattcctctacaaatggaatcggtacatccacgtcctttctacggaagaaaatcgatttctccttttcatcatctcctgctataattctataatttgttccttctgctgaatgagcgtactctaccttctgctcaaaattatactctgtaaaaaaatcattaatctcattacatccatctctatccaaatactgagccaaggacaaatctgtctttccgtaggattgaatcacctgatcaaacatattgatataaacagaattcttgaggtaatccatccatttaaccagaatcttattagatgcaaactttgtattaaaatacaatgttctaaggaatagagtatccttacctacatcactttcatcataaaaattcccagctttctcagcaatataagactttgcagaaactccaatacggtccaaaagaagctgatcctcaacatacaacttttctgtaattccaacttttctggtatcgacttctattgcatacttaaccttctttgtatcaatcaggaaatcataaaccaacgaatagctatatcccgttccaaacatgcacttaaacataccggaattaatacttctctctgagaacaaaagatccagaagcagcttcactgaaagaatgatattggatttaccagaagcatttgccccaacaaacatgcaccctttcagaacaccattctctgatacatttttaggcaaaaccgtataatttgttttcgtgagatcaactgtcgtctgatttttaaaggacttaaaattattcatcgtaattttcgtaagcataacagacctcccatggcattacctttctttttactataatataccatccgcgcaaatttaatgcaagttttttactctctttcgatacttaatcgtattttttttacgcgctcatcttgaatcttatatataacctggatgaaaagaaatgtcagcctcaggtaaaagaaatctgtaagaaacttgaagataaaaaatagaagtacgattttatcttcgtactcctactctttatcctcctaaaatcaagcaaaaatatcctcatcctgccagatacttattttcggatattcccaaggttattctcctgatatcttatgctcttttagaaagaacttcctcttcatacttcttcacttctttgaaccattcccctttgacaggcacattgttcttctcgcagaaataatcccatacatcgccgaaaggatatatcttcatttcttcctgcatagccatcagctcggtaaactgattggtatcctgaagctctttgaattttttattcggagaaacaagggcatacagaagggctttctgcatatttctcatgccaaccgtccatgcggaaatacgattgatgctggcatcgaagaaatccagggcaagaaggacacggtcgatggcatcatttctcacgatttcctttgcaatttctcttgtctcgtcatcaaacagcactacatggtcgctgtcccagcgtaccggccttgttacatgaagggcaattttttcattaaacagcagcatggaagaaatcttatcggatacaagctccgtaggatgataatgtccgttatccatcaggcttataatgtcgttgttagctgcataattaatggtgaattcgctggatcctacggtataggattccaggccgatgccgaacaccttggattccaggcataccagtaccttggatttatcataaggaatggataaaatctgatccagagaatctttaaatctggctctggggcccattctgtccgcagggatatccttatagccgtcaggaatccagatattcatggcgcaggggattccaagctcctcagcaaaatactgggaaatgcggacacatgcttttccatgctcaatccagaaattacggacttcatcaatggggctggataaagtaagtccgtccactaccttgctgtgagaaaagaaggtagggttgaaatccaggccgattcctctttctttggcaaaatccacccattttttaaaatgtttaggctccagcttatctctgtccgcaaattcgccgtcctcaaaaattgcatagctggcatgcaggttcagtttatgcttaccgggcaccaggctgaatactttatcaatatccgccatcagctcttccggtgtccttgcctttccgggataatttccggtagcctggattcctccggtaagaggccccttctggtcaaaaccggttacgtcatccccctgccagcagtgcatggaaattgcaattttctccagggtttccacggctttgtccgtatctacccccactgccgcatacatttcttttgcggattcatatctctcttttacgttcatgaattctcctttccgtccttttcggacaacacgtttttgacacgtgctttctgttttctattttcagtctactgccctccggcactgctccattcctgctattcttaatacctgcctgctgtcagctgggatcatacttttccacaccgaaggattcataaatacatgccctgacctgtgcaagccctgcaaattgattatccttcagcatctgtaccgccagattgccgatagctgtcgcttctcccggcccggcgtaaacggtgcggccggatttatccgcggtaagctggttcagataggccgcattggaaccgccgcccacgatattaacagcctcaaaatgccttcctgtcagcgattcaatttcccggacggtctcagcatagctgtccgccaggctctggtaaataactgcggcaatctgtccgaccgtttccggttccttccatccatgctttttgcagtaagtcctgatcgcttccgtcatattttcaggcgcaagaaaagcgtcgtcatttacgtctacgcgggaagggaaatcactttccttttccgccatttcacaaagccgggcaaaggaatatttatcctccagttcatggcggacggactgtatcatccaaaggcccatgatattcttcagataacggaaccggtattcataaccgccctcatttgtaaaattcctcttcctgctttccggcgtgcagatagctctgtcattttcaattcccatcagggaccatgtcccggaacttatgtaaaggcagtcctccgtaagcgtcggcacggaaatgaccgcggatgccgtatcgtgcgtagcaggcattaccacctcgcaggaaaagcccacttcttcctccacttctttggaaaaaggccccactaccgttccgggcatatgaagcggacggaatatcgagggcttatagcccagcctctcaatcagctcgcagtcccattgcctggtttccgggctgacaagctgtgtggatgtcgcattggtatattcggacatcttatttcctgtgagcaggaaatggaaataatcgggaagcatcagcagccattccgccttttccatgttttccggttcctgctgtttcaccgccatcagctgataaatcgtattgaaaatctgcttctggataccggttctggcatacagggcatcctcggggatgatcctgtaaacctccttatccattccttttgttcttccgtctctgtagccatatgtattgcccagtatcctgttctccccatcaagcagcacataatccaccgcccaggtatcaattcccatggacttaggcacttttcccgccgccttgcaggccttcagccccgctttgatctcttcaaacagcctggggatattccagcacagatgaccgtcctttttatccataccgttttcaaaccggtagacctcttccaactctattctgccattttccagatgacccagaatatgccggccgctggaagctccgatatccaccgcaagataatattcagccataatcttccccttccttcccgtgacttggcgccactctttgtaatcccgacttcactgagtttattatactcctttgccgttcttttttttaggacggtgattgcaaatttaccgtccttatttgcaggcgctttctttacagcttctttgacttactatgcctgaaatggtaaaatggcaatagcatatacgctgataaaggaagggaaacgatgaaccaggaacttttagataaactgaaggtgatttcaccggaagaagaacaaatccttgcgggagagacggaagtacagaaaagtatttatacagccgccgatgattttatcgtggacggaagccagatgctggatgccgggaaattgattgatatcaggcctcatacccgttttgtgcacttcccgcgccacaagcataattatattgaaatcatttacatgtgcagcggaaccaccacccacatcatcaatgacaccacaaaagtcactctggataccggcgatctcttgtttctgaatcagaatgccacacaggaaatactgcctgccgggaaagaagacatagccgtaaatttcattgtgcttcccgagttttttgacaggacctttcttatgatagatgaacgaagcgccctgcaggaatttctggtgggagccctgaaaaagaaccgcagctttacggattacctgcatttccatgtcagtcaggtcctaccgatacagaatctggtggaaaatctcatctggtctttagtttaccgccagcctaaccgcaggaacatcaaccagactaccatggggcttctgtttatccagcttttaaaccatacggataagatcaatcaggacgatcccgggcagcacgaacagaatatggtgttcaccgccatgaaatatgtggaggaaaattataagacagccacgctggacgagctctccgcgcagctgaaggaaccggcttattatttaagcaggctgatcagccggatgacaggaaagactttcaagaatttactgcagacaaaaaggctgaaccagtcagcctttctgctcaccacaacaacacttcccgtggaggaaattatagcgtctgtgggttatgacaacacaagttattttcaccggatattcagggcgcagttcggtatgacgccgcgctcctaccgcctgtcacatgattcggtcagttctcaggatacaggcaggtgatgccggaatgttcaaaaagctcaagccaggtatcagacggcttttcatcggtaaccaccatatggatatgattgatatcacagattttggaaaaagcaacctttccgaatttagtgtgatccacagccaggatacattgcttggctgatttcagcatggtctgcttcgcctgggaaaaaagctcatttccgtccgtaatccctttttccatatccaggcccttgcaggaaagaaccactttttccacgttaaaagccccaaggccttcaatggccctcggcccaaccagcgccagatacccttccttcaggcttccgccggaggaaatgatattccagtccgccacatcggaaagctccagtatcacttcgatggaattggtgattactgtcaggcgctccttctgcttcagcgctttggcaataaacacagcggtggtgctgggatccagtatgatatgatccccgtcttcgataagagtctctacaatctttgctattttctgctttcccgcaggattatttttctttcggatattaaagggcatatcaagactggtattttcatttaataccgccccgccatagctttttaccgccagcccatccttatccagcttatccagatcccttcggatagtctcctcggacacctggaactcctggctgagttcgctgacaataacctttttatcttcctgcagcttttcgagaatcagatttcttctttctactgctaacataagcaacccttccttatatgccttataatatgccttataaaatggaacggcaaatctgttcgtccggatgggcaatcacggaagaatccagatacattccattgcctgccactgattgttttgctttttctatggctgcttccaccgccgcaacctctccggtcaatatcagatatgattttccgcacattcccttggcgatacggagttcaatcagatccacaatagctgttttggctgccacatcggcagctacaataatggatgccgcatcgtaggtttccagtatgccgaaggcgctgatcttatcaatctgcgtagccccgtaaatagccgggaagatactttcatgaggattgccaaggacaaaactgtctatcagctcctcctccctcacctttcctgcagcttccaccgccgcattcaccgcgcttaaggatccgctgattaaagcaatatatttacccgggcagacagtctgtgcctccagaagctccacatccgccgtctttaccatcgcatccgcagcggtaatgcccgcggaaaccgtcttaaattcaatcatgcctatagccttgctcatatatctttacctctcatctgcgcgtttcgccgcttttctgatgattatgacacagtcagagtgatctcaccgccgcccactttggttactttaccgctgacggatgcatgaatcggaacgcttaatcctttggctgcagccgctattatctgtcctctttccaccgcatctcccacggataccaccggctccgccggcgcaccgatatgctggcttaaagggataaccaccacattcacctttttcacttcatcctcaataggcgcttccctgtcataagcagacagccctaatctcgcttccagccgttcttccggagccttacggtattctctggactctctcaccggggcaggaagtacgtccgcgggaggctttaatcccgcttttctcaggccagtcttatattcagccatcaggcttctcggagccaggccctgcgggcaggaatacagctcgcataaaccgcaggagctgcagaaaaacgtattcacaaaaggattggcatccctgaaatccctgttcgcggccgcacgcatgaacttatgaggttcgattggatgtcccagcgcatgccttggacataagtccgtacacgcctggcactgacagcaggcagatgcagcacgcttcaggcctatagccggattctggtttttcttctgaatcagggaatgttctctcgggagcaccagcaccgcgttggtcgttttggtcaccggcgaatcctcccctttgatatttcccatcatagggcctcctaccaggaagaccggatccgatgtcgtcgcaccgcctgcaaactccacacagtttttcagtgccgttcccagcggaacacggatagtcaccggactttccacctcgccgactatggttaccagcttatccgtaacaggcttattttgcttcaaagccctgtaaatattatacatcgtttctacattgaagacagcaatgccttcttctatgggaagaccccctggcctgacaacccttccggtcgcctcataaatgagcaccacctcatctcccataggatatacgctgtcaagaagctgcagtgatatcttggggaaacggtgaatgcatctgtttaatgccgccacagtgtccttatattcgcctttgattcctacgatggcctgttccgctcccacggtatccgccaccagctggaatgtttccagtatttcttccgcatgcttttcaagaagctgtctgtgcagcttcagaagcggttcacactccgcgcagttcaataatatgatctgagcacgttcatcaattttcatataggtgggaaagcctgcgccgcctgcgcccactatcccattttcttttatcatactgcttaagtctttacaatccatagcctgctccactttcccggaatcacactaatctgctggcatcatcaatgattcccactattgcggcatccacaggggcgtcttccatatcacagccgatcctggccgcacttccctgggctacaagcacgtattctccgattcctgcgccgatattatcgatagccaccagtctgtccgcatggcttttcatcgactccagaggctctacaatcatcaatttatttcctatcagcttctcactttttctcgtggaaacaatgcttcctgttactttaccgactatcatatttcctctttcccctgcctcggcagcctgttaaaaaatctcccggtattccagacaaaaagaataagaataccgggagacggttaacaactccatcagcggacaatttttacggtatctccggtagcgatcctgctcgcattcgcttcatccgtatcgatatgcatttccagcgtaaagctgtcatccacacggattttaacgtggtcaaaaacagttccccgttcgttgtctgcttttacagaaacgtagtcgccgtcttttacccctgctgcctgcgcatcccggggcgacatatgtatatgtctcatagccacgatacagccttccttcagatagattgctccctgaggcccaaccaccgcgatcgctgcgcttcctgccacgtcgcctgattcccgaatcggggctttgattcccagcttcatggcgtccgtagcggaaatttccacctgggaggctttccttacaggccctaaaacccttacgttttcaatggcccgcagctttagtcccactatggttacctgctcgttggcagcgaactgcccgcccatgagatccttttttttggtaagatggtatccggggccgaacaggatttccacatgctcctgggtaagatgtatatgtctggcggatacgcctacgggaaccataaacccgtttccggcaggttccttctccatggcttccattaccaatctggtaatcagttcaatttgattcgtctccacagccacacccacttttcttcagattatagaattattttaccttgggcaaaatcatctctacatcagtgtgaggtctggggattacatgggtagccactaattcgcccagtctgcctgcgctgcttgcgcctgcttccactgcggatttaacagctcctacatcgccgcgtaccataacggttaccagaccggaaccaattttttctgttcctaccaaagctacatttgcagccttgcacatagcgtccgctgcttcaattgctgcaacaagacctcttgtttccaccattcccaatgcttcctgtgacattcttttttcctcctttttaacaactggttcttcttttacctgcaccttttcggctttctgtactgtcccggacgttgttttgcgtgctgttttaatcgtactgctttttgaagctgccgcactctgtccggcttccttttgtgttgtcttatctttattattactgtctggcatgattcctcctcattaccgcagctacggctaaagcggcattagtcaggcgggcgcgctgccccttgcctatacctcctgaagatagctttcctccgaaagcattcctcctgccggattctcagcctcagccccggcttctttggaagcggtcataaaacggcttgaactgcgcttcaccaatccgacaatctcttcatgggggttggcaatcaccccggaagccaccagcggtttaatcgcatgagctgccgcttccacggctgcggttaccgccgccacatcgccttccacaataatggttacaagccttccgcccagttttctttcccaggttgccagagtcacttccgccgccttgcacataatatcaagggcatccaccgccgctgtcactcctgttatttctatcaggccatatgatttccccatgaacgttttctcctaattatcagatagaaggcagaatcttctctacatccgaatgcggtctcggaattacgtgtgccgctaccagttcgccaagcttgcctgccgctgcggatccgctttctactgcagccttaacagctccaacatcgccgcgtaccataacggttaccagaccggaaccgattttctctgttcccaccagagtcacctctgctgatttggtcattgcatccgccgcttcaattgctgcggtaagacctcttgtttctatcattcccaatgcttcctgtgccattttaatttcctccactaatttacatttcttttttattgtgacataaccagttatgacttgtcaaatgcgcagagcttcaacattttttccgtatcctctgtgggcctgggaatgatatgcttctgcacgactccggtaaggctttttgccatccgctctcccgcttccatggcagcttccacgtcggatatgctgcctctgaatttgatggttaccagcagggggaccggaaggctgtctgcgttggccggcttatttttatcaaaaggctccagccgcacattgcctgccttacatccggcatctgccgccataaatgcacataccagaccaaatacttccaaaattcctacggcttctcccatgggcttcgcctcctaacactgtttattgattgataatcgcaatcttcagaccgctcatcgccagattggttctgtgcgcttcattgatttcatccagcgggaaggtgtgggtaatgagcttctcaatgggaatcccggccttcttcgcactctttaagaattcaaatgtggtggcgtaatcccgaagagtatatacccaggagcccacgattgtgatttctttggagcagatgtcaaagtggggattaatggtggcatcgccgccattgataaagaatcccagctcgcagagccctcctccgttgcggataaatttgtaaatattagcatgggcaaacggagaaccggtgcactggaatgcaaaatctgccagatgtccgtcaaatttggcttccaccgctcctgcaagagcttcaatgcccttatgatccttgaaatttaccgtatcggacgcgcccatttccttagcgaattccagacgtttttcttctccgtccacagctacgatatgattgattcccatcgtacggagaatggcgatacaaatcaggccgataggaccgcagccctgtaccactaccctgctgttgaaccggaggataccggttgatttcgctctttccaccgcgtgaatcagaacggcgcagggctctatcagtattctggaatataaatccaggtcgcttaccttaaatacggtggagcctcccctgatgaaaagataatcggaaaaccagccgttgagatggatatcgtcatcgggaagcaggccgtaaacatccgcgcctcccacgttctgcttgttcagatcgaacatggtgatatccgggttatccttgaaaatcatacaggttacaaccttgtctcctaccttcaaatcatttccggcactgtctttttttacgtttttccccatctttacgatttcaccggttccctcatgtccgagggctacgggaatcagtccgaagggatcttttttgaattcatgggcgtcggtaccgcagataccgcagccctccactttaacaaggatatcgtcatcccctacctcggggatggggaattctttaatgtcataatgctccaggcttgtaagcatggcaacacgggctgttttcgggatttctcccgccacatttccggatacgctttttcccgcgccggtatgcccttccatgctgttaaggacctgtcttacaatctcttctatatttgttgcattaacgtccattttcttttcctttcctgccttccggcgtacatgcctttttaccggcatgtctgcacgttctgccctttagcggatgcagaggctgtctgacatgacacatcttcttctcttagtgaaggtgcttgcgctcgtcaggccctcaccggttctgctggcaatggtgaaggtacagaagccttctcctccgaatcccaaagccgcataggaaggtgcgttcttaaccagaatcgccgtatcaattgccttggcatatttggtgatgttatccacgtttttggaatggatatgagcggaatgacggttgccgtgttccagccagacggccttttcaaccgcatcgtcaaaatcctttgcccttaccagtcccaggataggcatcatcagctcttccgcaatcagcggatgttctttttccccttcaaaaacgatgcagcggatattttccggcgcctgaatgccgatcatggaaagaagtgttctggcatcccttcccacgcatttccggttcagccccttaggggttatcacagtcgcggtgagtttatcctgctcctctttggaaatcaggtagcatccctgttcgctgatcatataattcatcagctcatcggccacgctgtccacggccacaatttccttctccgctatacaggggagattattatcaaaggtacatccgtttacgatatcggccgccgcttttctcacatcggcagtctcatccaccagtgcgggaggatttcctgccccggcaccgattcctctttttccggaggaaagaaccgcggtaactactcccggtcctcctgtcgcggcaatcagagggatatctttatgcttcatcatgatattgcttgtttccagtgtgggcttgctgaccgtacaggccacattgtccggccctcctgcttcaagggaagcttcatttaccatgttgatggcaaaaatggaagttttgatagcctggggatgggggttgaatactactgtgtttcctgccgctatcatgcccatgctgttgcacaggacggtttcactgggattggtgcagggagtaatggctccgataacgccaaagggccccatctcgatcagggtaagtcctctgtcccccgaccatgccgtcgttgttatatcttccgttccgggggttttgtccgccagaaggtgatgctttaatatcttgtcgcccacgttgcccattccggtttcttccacacccatacgggcaagaagctccgcgttctcgtgagtctttctgcggatattggagacgatctgttcacgctgatccatggtcatgcagcgtactttggcttccgcttccttcgccgcttcaatcgcctggttcatatctgtgaacacgccgtgctgtgctgtcccggcactgccggaaagctgcattctggcaaccacttccttcacaatatcctgtaccatactttcacttacaggcacgagattacctccttcaacaaggacgctccataagccgcaaggctggtgtcctgctcggctgttccgccgctgacgccaagagctcctattattttgccgttatagataagcggttccccgccgccgaaaatcacaatcctgccgccgttcgtatgctggatgccgtaaagaggttcacccggccgggccagttctcccagcaccgcagtggacatctgaaaggccgcgcatgtataagccttattcactgccacatccagacttcctatgtaagctccgtccatgctgcgcaccagcttcggatgtccggcttcgtccgcgacggcggtaactacccgcattcccagctcttctgccttttcctccacctttgccgccagcgcttcggccagcctgagagacattccatggatgtatccatggatatatccattcacagccttcttcgcatccatggatacggaattctccgcagatgcttccatacggcctatctcctgcaggacttcgcggacagttcttgcaatcagctcttcgtccattattttatctgctccatgaccttttttacgatttcagctaccatatcttcgcttacatccttggatgcgggggaggatacggaaccacagccgtttccgcagttatggcagtttttcctgcccttattctggcacagatctgcgggatgctttccgggcagacccatttttcttctgatttcatacagtttctcaatcgtagcctgatcgaattccttcggtccgcccagcattctggacttgtacaaaagctctgcataaaattccacggattccatcttcatataagccgctgtcaggtcggtgctccatgtaagggcgccatggctttccagcagaaccgcatcatagtaaggaaggtatttttccacgttgtcgggaatctccgttgtggaaggggtgccgtactcagcaatcggaacacatcccaaagcgataaccgcttccggcatgataggctgtgtaagcgggatacctgcaatagcgaaggaggttgcaaatgtaggatgggcatgtaccactgctcccacgtcaggacgtttctgatatacacgcatatgcatcttaatttcggaagaaggacggaagcccttgttcgcctggattacatttccctgtgcatccaccttgcagatgaaatcaggggtcataaagcctttggaaacacctgtgggggtgcaaaggaattcattgtcattgagctttacggaaatgttgccgtcattggctgccaccatattacggtcataaattctctttccgatgtcacacatcaatttcttaagttcatactcgttctgcattatttcctccattctgccgccttcccgcggcgtaaaaatatgtccgcatccttatgcgtattctgaatgataaaattctgactgcttttcctgtttattatagtcccaaatacaacacatgtcaacatttcttatgtggtttttatttgttttatccggtttttcaactgttgtttttgttgtttgtaccgatttcttccgttttttcttctctcaggtaagaaaggatgtccggaacgcccgttcccactgtggaatccacgtaaaaaatctttttacagccggaaagccggagccatctggcagctctttccggatcggccttcggttcattgatctgggtcacaattcccaccacttcccggtttaccatgcaggtaatgttgggaggatacagggagtagggttccgtggcggacagcagaagccccaccacatccgcctcataggaatacagcgccagcgcatatcccagttcatgggtctgggcatactccccgggggtgtcgataatacactcgaaatagttcacatactgggttttgtggtatttgatttcttcccccttcagggcctgtgtcagagtggttttccccgcgccgctccttccgataagaatgatctttttcatgtccgtgttatgccgcagacttcataacccagtttgtctgccgtatactccagaatcgccatagtggacgcctccacctgggacaccgttccggtcacgattaaagatccgctgaagcgatccacaaagcccagagatacgccggaagatttgatggcgatatccgccatgataatggccgtttccgccggggttaccgtcatgatcccgatagcagcccggttcagctccactctcggatccagcccgagtttctcatacagttcgccgtcggggctggcgatgatatgggccagcgtaatctgtttgcccggaaccagttcctggacaattctctgttttctatccggattataattttcaaattccatttttattccccttgtccgcttcagcggacatgaattccataattcttttcacactcagccgccaatatggcagtccaggctgctcacccgttccactgcccttttcaggctttccatatgttcattcgcaggcggaagaatatccttcatcagatattcccggcccaggccttcatacttatcctgtcccagccgatggtaaggaagcaggtgaatacgcttcacgccgggcagggtatccgaaaaccttgcaatttcttcaatttccttttccgtatcattaaaggtgggaataaccggcacccggataatcagctctgtcttcccgctctccgcgatcttacgggcattttccagcatcagttcattgccttttcccgtaaattccttatgcttcccgctgtccatatgtttgatatccatcagatactgatccagccagggaagaagcttgtcaatagtctccatagaagcgcaggccatgctttccatcgccgtattgattccggcttcctttgccgcacgcagcagcgctgccgcaaaatccgcctgacacaggctttctcctccggaaagagtgaggcctcctccggaacgtctgtaataaggccgatcctttaccaccgtttccattaccgtccggaccgttacatcctcaccgataatcttcggctttccctgtaccatcatggtctgtatcccgtattcctgggactccgggttgcagcaccaccggcaccgcagaacgcagcctttcaggaatacaatggtgcggatccctctgccgtcatgaatggaataacgctgtatgtcaaaaatacggccggttgtatcaaggtaatccatttcactttcctctcttcctgccatcagaacccctgctccgtcctgcggatgatatcatcctgcagggaacgcgacaaggtggtaaagagggcgctgtagcctgccacacgcactaccagatgctgatacttttccggatacttctgggcatccagcagcgtatttctgtccactacgttaaactgcatatgacttcccttctgatcaaaataagaacggataagagccacgaaattattcagtccctcatccccgctcaatgcggaaggatggaatttctggttcagcagagttccgttggaagctatgccgtgatccagtttggaaacggagtttgccgtcgccgtagggccgtgaatgtctctgcctgccgtaggggaaacgccgtccgccacaggggtatgggcaaggcgcccgtccggggtagcccctgtctgggctcccagcggcacatttgcagacacagggtacaggcctgcctggaaaatcccgcccctgggattcctgtaattctggaggggcttggtataggtgtaggctacctccctggcaaaggaatctacttcttcaatatcattgccgtatttggggatttcgtcaatcattgcaaacagtttttcacaaagctccctgtccttgtcaggaatttccgtattcataatcccttttacaataccggcaatctgagcctggctgggctgctgtcccgccttcgcaagttctttgattatctcttccgtcatttcctgaacggtgatggaatcaaatcctttcccgaaattcagggcaagagctttcttatattccgaaagggtcactttcttttcttcaaataccagctttctgaccgcatacagggaatccgccacattagcgattccgaagccctgagggcctgtgaaattataaacagcgccgccttcctgaacggttttccctctcttcatgcaatcgtccaccatactggaaaggaagggcagcggacagcggtccgcatgggcggtatcgatagcattgtccgcgtttaccagcagactgatacagtactccatctgctttttgtatgcatcataaaattcttcaaaggtgcccatctgttccacagggccggtggcaagccccacctgctctcctttatcttttccgttggagaaaacaagctccagcggacggcacatattgaaaaatgcggcatcatgccagccttcggtcttgccggccttctgcggctccacacagccgatgatattgtaggttctggcatcctccagggtcagtccccggttcatcagggagggaatgatcacctcgtcattgtaataagccggaagtccgattccggtccttgtcagtttggccgcctccaccagaagttcgtgaggcgtacagttccatactctgacggacagggacggctgcggcaggaatacatgagcggaggcccagatacacaggaaggataaatcattggtgacatcctctccattctcattctgtccgcccacaatcagattctggaacaggctgtagccggcaaagccttccgcactggcggcgtctctcgccttattcagatcattcagttttacccagatacagtcaaccagttcctgggcttcatccctggttatttttccctctgccatatccttctgataataaggatacatatactggtcaaaacgccccggagaaatagaatgcccgctggattccatctggagcagctgctggacaaaccagaagctctgacaggcctcatggaagctgctcgcccccctggcaggcaccctttcacagacagaagctatctgcagcagttcctcttttctcttcctgtccgtacaggcttcggcctcctgttttgcaagagcggcataacggcctgcataaccgataacggcggcacagctcatgattacagcttccaggaagcagtgctttctggcatagtccccgtcgcccacattgcaggcggccagttcccgggctgcttctctgataatgccttccagaccgatttccagtactttttcatattggacggttacatgtcccacaccattataaaaataatttcccggcgtaaagatattatgttcaatcgcagctgccgcttccggcgccatataggaaagggcaagctcgcttgtggttttccctttccagtatttatgtacttcccgtaattttttcttggtatcctcggaaatatagaagggatccgcactccgtttttcgatcgtatcgaattccgcttccagccattcataagaaaattccgggaaggtctggcagcctctgggcgccagtgtggagcttcccaccacaagctcttcctcacggatagtgattggaatatgggcaagaatatgagcaaaggccttggccctgcgcataataataggttcgccctccgtctccctgtagctttccgtcagcagtaccgccctgtccggctcaatttccggcatcttacggtacaggttttcaaccagcctggagatacgttccgatttggctgtaggatcggtgttgaatttactgctcatcctgcgtttccctccatagttctctcccggtaacatgaactgaaaaattctcataccggaaggcattatatcgtactgcatatcgttgttttatgttttgcccaaaagcaggcatcttttatgtggttttccataatcagtatagttgctgcagtccaaaatgtcaataaatacctcatgatttatatttgttttttgttgttttctttctttatatctgttgttttgttgtaggctttcatttttagctgtttttcttctccggaagtcttaattaccctgacgttctcagcttatccgggttccatgaagggttcagataaaaaagtgaatgccgcctgagacagtggatatctttcccgcggggtgcttccgtgccggcggcgcagctcttccctgctgccgtccccggggaatcagtgattcctgtaaggggcgtctaaaaacgccagtactaacgctgcgtcctttgcagcgttagtactgctgcgtttttaaccgaatgagaatgtcccctgtaaggaacactgattccccggggacggcagcagggaagagctgcgatgccggcacggaggcatcccacgggaaagatatccactgtctcaggcggcattcactttttcatcggcacctctccacgaagcgtaggttgcaatccgtttccatctcccttatgcttggaataaagaaagacagctttgtttttccaatcaccatgctgttcctgacagcggaaaggataaaaaatgaatcattatattaccggaaatactatccgggtccttcgggagaaaaaacaaatcacccagaaagagctggctcagatattaggcgtaagcgacaaagccatctccaaatgggaaaccgcaaaaggctatcccgatatcagcctgctggagccgttggctgccgctctggacatctctgttgcagagcttctcagtggtgactatgtgacaaatcagaataaaatggggaatatgcttcgcagtgtcttctatatctgccccgtatgcggaaatgttatccatgccatgggaaaatgtgtggtgagctgctgcggcattactctgcttccggaggagactgaagaaacagacagcgcccataccatcgccattgagcaggtggaggatgaatcctatgtcaccatagaccatgaaatgagtaagtcacatcatatttcctttattgcctgggtgacttccggcaggctggaacttttaaagctttatccggagcaaaatgcggaaggtcggttccggctcagagggcatggctgtctgtatatttattgcaataagcatgggcttatgagacagagaatctgacagggggccggaattatttttatgaatttttcaaagagacgcggaaagctgctgccttccgcgtctcagattgtaaacaacgtatattttcttattcctgctttacttatatctaatgccttttcctttttctaaaaacaaacaatccggctgctgcaataattaccagtacaattaaaacaaatgttaatatatttccggaacagcctgaaacttctgccgcagaattatcagcggccgctgcatctgctgtatctatcggaatattttccgtttcatcagcattgttcatttctgcctttgcctgtctttccagttctttttccgtaaaagttccttcattgatataattctgcattctctctgccattgaatttgccgcagcatctacaattttcaaatcgttcaattctaaacctgacacctgccatatgtacaggggattatcttcattaagaaaaccacaaagatatatctcgccgactgtagggctttgggctatatacttctcataggtctgtacgctgtcctttgaaaattcgcctttaatattttgacgttgtactacggtaatactttcaccgtcaatatcaataatttcaccaaaatagacctgtgcagaatcactattaagcaaactttccggaatgtccccggcataacatactgtaacggccgacagtgcaatgagcaaagttactatgggtaataaaatctttttcttaataatattgtcctcccgttccgactttttatatgatacagattcccgataaattgataaccgactctctgaatagttattacaagagagattactgtatatacattacaattccattttcatatagataagttcctgaaatcctgtctttcgagaatgaaagccttttggattcctgccgtattcaacaaagcctgctcttgtatacatagctattgctcttgtattttcagcaactacattgagttcaagctgtacatatcccgcatttctcgcacattcaatacaggcattcattaatgcccatccgattcccaatccccaaaactctttggcgacactaatacccaattccgcacgatgctttaccttgtacttcgtgcctactgcttcgatcccggcagttcctgcaactacattgtcaaccacggcaattatctctatttcattttcactctcggacttttccttcaagaatttactctcctgttcggcatcaaaactattctcgtccggataggaaagcaaatagtctgtttgggaatgagttaaattaaagttttcaaatacagactgtccgtcgttttcatttccatttctcaaacagcattctttgttgttctttaatcttatcttcttattgtatttcaaaataaatgctcctttatatcaagtaatgttcttaattccaatattcttttttcaaacatacaatagtcatttaacatgtcatgctgtaacttttgagcggtttttattgcccgttcatactgctcacctgatatttctttttggttgaaggcatcttccaactcgtccctgtcatcaacgataacttctcccgttggatacaccactaaatccaaatacaaatctataaaataaggaattccatcctcatcaattccctgactttcaatcatatcaatataacaaacctgtatttcatttagctggttcatcataactgtaatacagtagaaatcatccttcggcataatagatagccatctgtactgattatcgcaaacaatgatatctttatctcgatatttccatatttgtttttcacttacttcatgtattctcaaatcaccaatatatccgacaaaatcctctgttttaataaattttcctttttgctctttcgatttcatgcatttccattcatcatagacaagtctgcatttatacatatcagatatctccttaatatcttaacattctttgctgttattatgtagataaattccgcttggctaaaattataccagtgtaataagtaaaaagaaagcactgtatatttatatttctgatatacagtgctttcttttataaatgactttttctaagatttaaaatacgtacaattgataatttattcatctttttcagaacttttcccctttattaccattctccataattaccggaacagattcagcagtctctgccaaaaagtaagcggttcttctactgtttccgttttccctttttcaggcatcttaatcccctcggtcttcatgataaactgtaccagattaacatttgtatttttatccgagacaaaggaaagcggagtgaaatcacttcccgaaaaattggttattaccttgttcacttcttcatcaatcttctcatcaatgtctgaagttttgtctttgaattcatcggttccgtccttcagttctcccacgccatccagcaaatcattggtcccgtcaaataaatcaccggttccatccgcaagctgaccggatccgtctttcagatcgtcggaagcatctgtgagttctttcacgccatccgccagatcagatactccggactgcagatccttcgtaccatctgccagttcccagcctccgtcatttaattcggataccccggactgcagctggttggtaccgtccgccaactggctgattccatccgcgagggaacctgctccgtctgcaagggaagcgacaccgtcttttaaggcggaagcgccttcggtgagttgtttgagctgggcttgagttgtggtgcttcctaacccctgtctggtcatgtaactgcccaacatttgatctactccctccttagcagaaagcaatagactcagcatatttcccgaaccggtgccctgtctggtatcagctaacctcattacttctatatcactttgagcaagagttcccttttttctgtaatccagagttgctaatgtatatgctgcgtattttttttcatattttgcatcaattatggtttcatcattctgtatttcttcgcttctatcagtctcttgaactttactggattccgtaatttttgtttcttcttcggattgtttttcgttattgtcctttgattcttctgtattttctttctgctcagattccgctgtctcttccgctgtttccgtactttctgtttcttctattgtatcttcagtttcttttgcattttcttgttcagtttcttcttcgcatttttcttcaatcgaatttccggagactgcagaatcagcagattttttattttctaaaacagaatttttttctcctgatataggcgttgggtttgcaataattcccttaataatctgatctaaaaaactggataaaccttgaagctgtttgaccgctgtatttccttgtaattgataagtaataccattgtcatttagttgttcaacaatttgattaactattattttatcattgtcactcaattgctgcacattccccatcttcagcatttcggccacaaacgcattaaccccatcactcaactgcccggcaccactcttcagcttatccgccccttccgccagcttcttcgcaccggcagccgcgccttcgtctccattatagcctccggccagtttatccacgccttctttcaaagaggaaataccatcggccagttcactggctccatcggccagatcgtccgttccgtctttcagggtatcgacgccgtctcccagggaatatgcgccatccgcgtaactctcaatcccctccttaaggctgtttgccccatccttcaaatccgccgcgccatccttaagcgcaccggctccatcggataattctgctgcgccgtcggaaaattcattcgccgcatcttttatctcaccggtcttatcatacaggctatccatggataaagtatctctgtccagatcaaaggacatgggaactccctggaagcttattggatccattttaaaatccaggacatccgccgtaatgacaatatctttttcctggcctgccatgatattataaaccagctgcttggaggttcctttgttgcctactgtggctcccgccgccttcaggctgctgcagttgtccatattcatggttacggtagcctgaagcaggtaattttcaaaaaattcttcatccacactgtcattttttcctacatgtatggttattttcaggcttccgttctttccggccagttcatctgcctgcatctcttttccgtccagataataatgaatggtgatttcccatggcatttctttggttttcaggttcccctggtagaaaaaattacctgcgggagccgtcgtggtaatcgtatctccctttttggtcagttcctcatccgtggtaagattttttacggaatcgtattttccgtaatccacaatatccgtttccttttccagccggaaggcattgaccacataaatgccgtccacacttccgtcctggttcaggttcacatatacgttttcatctttcggtatatcagaacctgctgccgccgcggaaaacccgctgccgaacagcatggctgctgacagaatacaggctgtgctctttactgcaaggtttctatattttttcatagtcactcctccttatctgctgctttaccggtttccgccatttcttttctgtaaaaatcacagtgcagagttgtccgccttatcactccgtcaaaaaggatcagcagagttggcagaacaaaaataactaaaacaaaggacagcgccgctccccgtccaatcagtattcccagctggctcaatacgccattggtggataccttccccagtatcacacctgccagagtaagtacggcggcggacgtaagaatagatatggtacaggtcctgagagtcataaacgccgcttcctttttaggaagtgttttcctgaaatccatataccgatcggaaaacaggatggcataatcgatggtggctcccagctgaacggtgctgattatcagatatccgatataaaacaatgtctgtccccggaaataagggattcccagattaatccagatggaggattctataaccagcgtcaaaataaccggcagggacagggacttaaagtttaccagcaaaatacagaatacgaaggcaatagccaggaaattcactttggcgttatcctgggtaatcgtagttttcagatcctcggtgctcaccaaatctcctgcatattggattttatcaccataatacttttcacctatattccggatatcattcaccttttcataccagtccggatccttttcctccgcttccatggtaatgacaaaccggctgtaatgggcggaataaagacgggatacggtttcggaaggcaggaaagaggaaggaatagcattccctacggaattcacataggaaaccacacttgttacgcagtccagttttttcagttcctcattcatggcgatttctttttccatatctcccttgggcaccataagcactaccgggttggaagaaccaaacattttatcaataacttccatatcacggcccatctgtgtggcctgcgtgctgtatacctggcttcctccataaaagaagtcgtttttcatctgccccaggaaggaaaccggcagtatcacaatgacaaacgcaagcaccgggatccgaagcttcatgaccaggccggcgaatttatcgaatttgggaacaaaggtgcgatgctgtgttttatctatcaaacggtatgtggaaatagccagcgccggaaggaaacataacacgctcaccaggcttaagacaatggccttcgacataacccagcccatatccggcccgattttgaaacgcatgagcaccagggctaaaaagccggtaactgtcgtaagtccgctggaaagaatgctccccacagactgctttaccgcttcgatcatcgctttttccaccggcaggccctcttccctgttttctgaaaaccggtgaaggaggaaaatagaataatccatggatacagccagctgcagtacgcttcctgccgcatttgtcacgaaggaaacggttccgaacatcagatttgttccccggtttatcaagatcgccactccgatggttatcataaacagcaccggttcaaaccaggagttagtggtcagaataagaatcaggaagataatgggtacagccagaaacataatctgctgcacctctacggaggtatttaccggagccagaaccgaggtcaccgcagtgcccgacatacagttttcttctccgataatctctcttaccgcaggtatcacactgtcctgctttttctcatcgacagttacactgaacagtgcgtttccgtctttgtaccaatcctccaccgtcttctgctccgccagttccagcggttcataaatatctaccgcatcatccagccagttgacctcttccacgccgtccacatccgctattttttctttatacgcaagcgcctggggaatggagactccatataccagcaccctcatattaggcacggactggctgtattcctcatccatcacctcaagtgccctggtggaagcggcatcgtcaggcagataatcggcaaaattataattcacgcccaccagaccggaaagaaccgcacacaggacagctgccaaaacgaatacacctatgataagcttcttatgtttcagtaaaaattgggtatatcgttccattttttcactcctcaatttactcaactctattttattactcaacaactgttcattttcttgcttttctaaattatattaattataattatctaatacaataatcagtgttcatatttgtgtttgttaatgaacatttttggactttatgtttattttttatatttttttaatatttctgcgccaaaacctgtacgctggaaagttcgcctcatgaaagaaggaatgatatggaacctgcaaaaaccgaccgccgggtccggaaaacaaaagcgcgtcttctggaatgtctgacggcattgatgaaagaaaaggatattaaagatatttccgtcaaggagctttccgatctcgccgatatcaaccggggtaccttctacctgcattacagagatgtctatgatatgctgaataaagtagaggatgagcttttcgctgaattcaatgaaatattgaaccgggattttacaatcgtgccggaggataccatctataccattttggaggatatcttcacctttctttatgacaacgtacagacggcccaggcactgatgggccctcatggggatctcacctttataaaccggatgaaagacgtggtaaagcagcgcatccttcagatttggcgggcaaaccagcagccttccgaagcatttgactattactattcttttctggtatccggctgtatcggcttggttgaagcctggcttaacaaagagactccggagactcccaagcaaattgccatactggccggtgatttaattaaacagggctttatcaacccggttttttagttttttatacaaaaaggcttcccgccatgcggacagcaggttttattccttgtctgtcagcggcaggaagccctttttaccactcgcgttcccatctcctatcttcaataaaagacggcccgttataaattctgtgacataaatgcctgcagttcctgataggccacttcctcatccttcccggaaatttgcaagtgcagtttgtccccttcccggatgttcatatgcaggatccccaacagctttctcagattaccgctcctgtcaccatccgtaagaataacatcactctcaaaatcccttacaagatgcatcattacccctgccacacgcgggtgcagcccaacaaccgatcgtaccgtgtgatcaaattctctcataaaatgccctccataatgccccttgttacacaaacattatatcatatgcatacacaccgcacaagtattcctgtcatttatcgtcaattcattgtgcgattttacatattttttgcatttatgaaaggtttttgtgcacctttatcatattatagcgaatccattattcttctgtcccgcttataaagagatttctcattctgcggactaccgatgtgaggccggaatccgttttctgcatcataaaaagcattgtcatcccggccgccggatcattggcaaagtaacagccgagccatccgtcccagccatattctcccacatgattcagggttacggactgccccggatccttcattacccgcatcagattcccataactaaagccgggcatattggaaaagttacggacaaatgccgcccgctgtacctggtcgagctgtcctgccgtcataaagcgtaccgtggcaggctgaagaatccgtctgccgtccagtttcccttcattcagcagcatctgggcaaaccgtgcataatcatcaatcgtggaaaccagtccggccccgcctgattcaaatgccggctgcctgtccatggcattgattattcccagatggttctcttcgtatctcaccagttccccattttcatccaaccggtatgctgccgccagacgccctttcttctcttccggcacaaaaaatcccgtatccttcatcccaagaggcccgaaaagatttttttccaggaaagcgccgaatgtcatgccggacgccgcctcaatcaccgctccgaggacatccgcggaagtcccgtaaagccaggaagtcccgggatggaatttcagaggccctctgcccagcgcttctgctatttccactgttgtcatggcctgagccgtcagcagtctttcatccacctgattaaatacctctgtggcatattctcctgccggtcccggatttccattatacacaagcccggaggtcatacccagcagatccttaaccgtaacctctctctccgccggtaccagcctgccgttttcttccaccatctgcccgctgaaggccggcagataagaagaaaccggctcagccaaatccagctttccctgctcaaacagtatcatggccgcagccccggtcaccggcttgctcatggaataaagacggtaaatatgatccctgcggatggcctctcccttttccttatccgccataccgctttccagataacatatttcctccccaccctgcctgatgagcatgcttccgcctgccagttccttatcggcaactgccgcgtccagcatttcctgcattttttctttaatttctgctttcatttctgcgtcttccttcccctttgttttctgtttatgttgtgtacttattttctcacagcgctttccgtttgaaaaggagccactgcaattttcatcacatgatcccgcttattttcgaagatatcataagcctccatgatttcatccagagaaaatctgtgggttatcatacaagtggtatcaatacgtccttcggcgatcagggccagaatgtcatcacaggcattggcatccacgcctcccgttttaaaggtcaggtttttgccgtacatatcgggcaaaggaagcgcctgtgcctcttcatacaatgccactatgcatacgataccgtttggccgcgcagccttccaggccagctgaaaagtatccgtcccgcctgccgcctcgataaccacgtcagcgcccctgccttccgtcatttccttcaaaacctcttccacatcctcttttccgggattgattacccgatccgcaagccctctgcttttcacaaattccaggcgttcttcactgatatccgcacagacaacggctcccggttcatacagcgcagcgcacataagcgtgcacagtcctgcaggccccgctcccagcaccagcaccgtatcccctttatgaatttcactgatctgcgccgcccaatagccggtagacaaaatatccccggtaaaaagagcctgttcatcactcacattctccggaatcaaattcaggccgttatcggcaaaaggcacccgcacatattccgcctgcccgccgtcaatgcggcaccccagcgcccatccgccctgttcatccgcacaattattcacaaaacccttcctgcagaaaaagcattccccgcaaaaggtttccacattaacgctcaccctgtcgcctgccctgaatttcttcactcccggtccggcttccatcacttccccaaccatttcatgtcccacgataactccttcagccgcccgcggcacacttccatgcttaatatgaatatcgctggagcatatggaacataatgtcacccggacaacagcatcccccggatccttaatcacaggaacctcgcgttcctccagactgaaaacccctttttccttatacactaccgccttcataacagccctcacttcttcttttcatcccgcagtcttctcctctgagacactgccgcgacacagcaaagtataccaccaggacattccctccgcaagcccggcctgcaaataaaaacagatggcgctgcggatattttttcccgcgttccatctgtttcttctgattttatgcaccttccaccatactgcagtccttaaggatgaccgattccaccccgtcagcctcccggtatccttttctgcggagcacctcattaaccgcttccttaaagtcctccatggaaagcttaaccttctccttattcttcaggactaaaatacaaccctcctggaactcacagttctcttcgcaggaaatacggtataaattctttctgtctatggctccgatttcttccagcgtttttaccatgcggtatacggtggcaattccgatagagggatcctcatgtacggctttataataaatttccttacagcaggagcattcatccgaaagaataatatccacaagcagcttcctctggttggtaatacggaagccgttccttttcagttctgcaagaatacggtccctgcgtccggcatttttcataaattctctgttatcctgtttttcttttatcatccgattcactcctgtctgtttcattttacctcgccgctctttacgcttccatggcaggcacatgcgttggaacagcccccgcaggaacctccgcagccgccttttcccgttttcttatcccggatcatggtgcgcagcaccaatgccacaatgataagaagaactgctcctgttaatatggttccgatgttatttatgagaaaggtcatattttccatctcctttttctttttgagaatggttatcatttaattcatctacagttagtataagctaactttcattttttgtcaatcctttcttttgcaattaatggaaggcaattaagggaagagaaaaaagggaacgccgccatccatattcctgattcccctggatgccgcctgattcccttatatttcctgtttacagaacatatgttctgacatatacttttctcatgaaaccaattatttttcatgtggatgtaaataatgctttcctctcctgggaagcggtataccgcctgaagcacctgggcggaaggacggatctgcgcgaacagctctgtgtagtgggcggcgacgccagtaagaggcacggcattgtcctggccaaatccctttccgcaaaggcctgcgggatccataccggggaaagcctgatggaggcgcgtcagaaatgccccgatctgcttgtcgttcctcctcattaccggctttacagccgctgctcccgcgcatttatggatattctccgggaatacactccctgtgtggagcagtatagtattgatgaagcttttatggatatgagcggcacgcagtccctctggggggatcctcttttgacggcggatacgctgcgccggaggatttatgaagagctgggctttacagtgaatatcgggatttcggagaataagcttctggcaaaaatggcctctgattttcaaaagcccaaccgtacccatacccttttcccggaggaaatcccccgcaaaatgtggccgctcccggtcaccgatcttttctttgtgggaagagcctctttttcccggctccgcagacttgggatttctaccatcggcgagctggcccacatggacagagaattgctgcggactcatttcaaatcctatggggaagttatctggaattacgccaacggcagggactgcgcccaggtggaaagcgttgttccgcccaataaaggctatgggaactccaccaccatcgcttttgatatatgcgacacggtttccgcaggccttgtactgctttccctcgcggaaaccataggcatgcgccttcgcagggaccaggtcaaaatccaggtaatcgccgtcagcatcaaatatgcggatttttcatcttgctcccaccagaaaaccctgcccgcccccaccaacatcaccaacgaaatttatcataccgccctggagctcttccatgaatcctgggatggctgcacgccaatccggcatctgggaatccatacgaaccatgtacgggacaacgtggattaccggcagctgcatttactggatatggaactgtcccccttctacagggacgacattccctgctgtgaaaagctggagcaggcggacgccatggccgaccggattcggagccgttacggtatcgattctctcaaaagggccgtttttgtaaaacaaaatgccatggatcacatgtcaggcggtattacgcgtgaaaaattagatgtggattacgaaaaggaaagtcttttataagctttcggaaaggataaggaaaggaggacataagccttgctcattcatacggataacgatattaactacaatcacgaaacggaagaaaggccgaaaaaaaaccggaaagagatcgcctgctgcagctggacgaccgcttccggtcagatcattcccattcttttcaaaatgcaggatgaagaagggctggtccgcaccttcagcaaaatccacgtaaaccattcttccaaaaaactttatgccggaatcccttcctatgaattcgactgtgatgtcctcgtaaacggcctcgtggtaaatgtcctgctccagtattatccggaagacagccgctggaccttaagcgaaatcccatgatcctggcacagcctcaccgggagacggcaggaacggccgggcggggccagggaggacagcgcggccgccaaaacgcctaatcaaaaagggaaagctgcccttttacctctttttccagaagccccggctttttatggaggaggatatccgtggcctccgaatcaaacatccagctttccgcttcctccggctccaggatcagcggcatcctgtgatggattccttccagagaagcattcgcctgcgtggtcagtatcacaaaccgttcactgccctcatattgcctgtaaaacccagcaaacagcaggactctgtgatccggggagcggaaaaaatatttatccttcttttccgaccattcataaaaacccgttgccggaataatacagcgccgttcctttacactatcccggaatgtcttcttttccagggccgtttcactgcgggcgttaaaaatgacactctttttatcgaagccgggaaagccccatgtaaattcttccgccagcatccggtcgttctgtccgataattaccggcgcttttccggaaggatatacatccctttccttacaggcgagcagcaggctgtcgttaatctgccggataagcttctctatttctttcgccgtttcatcattgatataatatcttccgcacatcgctgtcctccgggattttcctgttctgcggttttgtccgccgcagaagcgtttttctgccaaagcttctttttatattcttacacaaaatcaggaattcattcctcagtctccggagcattccgtatattccattccgcagaaagccttcaggaattccttttctccgtaacccgggaattcagccgtcagcacagcctcatcctcagcgacaaccttcccttttccatattttctgtgggtaatatacctttcctgcggcgcttcttcctttggctccggcttctttgccgactctgcggccgcctggtccggctcttctgccattgtcggccgttccgcctttttctccgcttctcctgccgctctttcttccaatatcatttttttcagggtctgcagatcattttccgcgccgcctgacgcatcgttctcaaccaaagcctgcggaatcattctgaggaaccggctttcccccggcaccaccctgctttccggattggtataaaaggaaagctccagataatcctttacccgggtcattcccacaaaaaacagccgcctctcctcgtcttcctcctcaaaatcccgtgtgcgcagaggaatcagcccgtagtttactccaatgataaacacatgggaaaattccagcccctttgaagcatgcagcgtcatcagtctcacaccgtccccttcttcgtcctctttcttcaccggaatcccatataatacagaggtattcaaaaatgtcctccacgcggcctccaaagccgtttgtccctctccttccggctgcggagattctccgtgaagcagatcatttccctgacgcagaacgtttccatgaagcagggcgttttcatgaaaaggaagcgtctcaaaagccgtctgaaacaacatcagcagggaatccctgtcctcctgccaggtacgcgaggtgggatggatatagctgtccagatcaaaataggaatacaaagcctccgggctgtctatctccggacaggcttccaaaaaaccggtcatcctctcatacagagggcagccttccgtcttttcttccttcagaataacggaagccgccttctcagaaagaggcttgcccgatctgcgttccccatactctttatggctcagggcataaatccccgcccctctgtctttgggattcagggaaaaacgcagaacctggagcatccagtacagcacagggatatcccggatcgtttttttgaccgacacctgaaaggggattccgttttgggcgaacacttcctcaagtacgccggattggttctgaagccggtaaaaaacagctatctgcctgaaggggatcccatcctgcaccagcccccggatccgatccgcaagataacaggcctcctgaaagggatcatagtggttttttaccacgattttgcttccgccctgcctgctgccggtaaacccgccgccgttctgcgcaaaagcgcccgctgcctgaagaatcgtttcgctggaacgatagtttacgggcagggacagctccacagcatcataagccgcccgcagggtataaaacacattgcaggcgctgcccctccagctgtaaatcacctgattgggatccccgacggcaaaaagagacgcccccttgtccaccagcctttgaatcagacgcagctgcagggcgtcgcagtcctgtacctcatcaataatcacccattgcggcttccattccgtaccttccagcagctgctccgtgttaaaaagcagatcggaaaagctcatcctgtctcttttctttttttcttccttcagcgcttcctgaaggagcggcatatcgtcctgaatacgggaactgttccgtcccggggtaccttccgtctcctgttccagtctttttttcagacggtttttgtatttgatctgcagctttctttcccgaatcagttccagcgccaaatccagctcctcttccgggtccatcacctggaaatcagcagtatagcccaactgccccacaggcaggacctcccgcagaagctgcagcgccacgctgtgaaaggtgccgaaataccgcatatcaggcagattggaggcttcttccgatgccgccagcctctcttttatttcatttgccgccttattggtaaaggtgagcaccaccatgtcccggtagcttatatccgccgattcatggagataccttattttcaccgtaaggaccgtggttttgccgctccccacattggcattgacaaggcaggcgctgcttttgtccagcaccgccttcctttgatattcattcagataaccgggcatcacaaactcacccatgaaatactcctttttccagcttcttttgtatctgtttcctttcctccccatcctccttttccgtcaggcggatttccagcttcagatctccgggagcctgggtataataacggaaaatattcagaaggctgttataattattcttttccataatccaatcccggtaaaaacggttggcagtgctcagactgagagtattcccttccagaacggcaccgggcgacatacttaaaaaggaagcgaaaggatctcccttttctttcagatatgtacagaactccatccatttctccggttcccccaattccttcaaaagaaagggcttttgaagagaagggatttcccgatgacggttcaggcggatttcttccggcggcgccgactcctccagcagatttttcagtccccataaaaccaggctcttgtccagccagtggtcaccgatacaggctgcacagccgttttcacaggggcagcctgacaccagcgttattgcattatctatgatccggggaataaaatccgctattttatccgcataccccagtccgccctcatactggtcgtaaaaaaacaatgcagtctcctctccgggcggaagagaatcctcctgccacagcgcaggatcccactccccgccgctcatatcaccggaaaccgccgtaccgatatcctcccgttctgtcatcgtcaccatcattgccgcatttttcaatgcataggccaatccttcaaagtgattgttccgaatgattttcccgtcttccttcacctgcagcagcctccggtagacgacggacacattatccggtatggcaatccaggccccttccgtatcgaaatccttggaaagaggttccggcagctgctcaaagcccagattctgatggttatggaactgcagcttacggtatatggaaaccatggtatgcacgttcacatccccgaaggatatgcgcgtccgtccataatccgtatcccggctgctgtgtatcacggaaatttccgttcctcctcccggcatggtgtaataatttccaaaaaagggctgcgcggacgcaatccttgtttccctgtccagggaggttacctgatactgtaccccgtcatgcatatataccgcgccttcatggatttcccggaaggcctgcatttcgtccatctccgtaatttcccggccattttcctgatttatcagcttatacctggccttgtcgatattgcgcaggctgaaatcccctgcagggaacgctccgcccgaccaggcgaactttccgtcccggctgtccacttcctttaccttcagcaaaaccggtatggcctcccccaaatcaggaaacagggcgatgtcgtccagtgtcaggggcatttccgcagcggccgcccggatatggaccagctcgatgagcagattgttcttatccacaatcgccgtttcactctctcctccgaacagccagtccggattcacggctacatactgatcaaaggggaggttctcaagaatcagatagttcacgcacccctttccatttctccccgcccgtcctgtctgctgccagaaggaggccctggtaccgggatagcccaccagtaccgtggattcaatctttccgatatcaatccccagctccagcgcattggtggatatcaggcctgtcagagctccggataccattttattttcaatttccttccgttcattgggcgtatagccgcccctgtagccggatattttatccttcctgcccgttccggaaaagctttccgattccaggatatccgaggactccttcaaaacaacttccacgttcctccgggatttggtgaaggcaataaagcttctttccgcctccaccagctgggggatcagatgggacgccacttccgtggaagaaacctgtccgtaattttttccatcctttcccttaatagccggaggctggaggaatacatatcttcttggcccggccggagaaccgtctctggaaatccgggtaaattcctgcccgcatatctcctccgccagctccacaggattggcgatggtggccgagctgcacaggaacctgggggaagaacggtaatatctgcagattctcccgagacgccggaacacattggcgagatgagagccgaaagcccccctgtaggtatgcagttcatcgatcaccacaaatttcagattgctgaaaataaaatcaaatccatatctgctgtgattgggaaggaatgccccgttaagcatttccggattggtaagtatcaggttcgcatttttacgaatcctgcttctctcacttgccggcgtatccccgtcataaactcctgccgaaatccggttttccccgaagtaatcaatcaccggcagaatcgcccggtactgatccgccgccagcgccttggtcggataaataaatacggcccgcgccagcggatctttcagtatttcctgaagcaccggcagaagaaagcttaacgtttttccgctggcggtagatgttgtgatcacaagattcttcccttcctgcgctttttcaaacatttccgcctgatggcagtacaatcctgaaattccctgttttttcagatatgcggaaagctccggaagcatatcttcgggaaaatcggaatatatggcttctctcgccggatattccttggtatatgttatgagatccttaatttccatttacaactcctgttattcctgtaactgatccagtatgtaaggatccttaatcttagtatctccggcgaataatacgatcttggacataatctccgccgttttgggatcctcgtccagaaacggcaggaacagctttcctctgctctgggaatgaacgggcagtacctgaatctgatgccctccctgccggtggatcacaccgctgcccaaatgaatactgtaattccctctgctgccttttatcagcgcatggcttccctccagcacaacattgtctatgccgaaaagaggcaggttgtattccacaatggcctttctcatttccacagtggaatgactggtctccggatccactccgcccgcatgggctacgctcaccgcaagatccacatccctcataacctcagaatatacaatggcgggaatatcctttatctttatactttcccccgttttcctgtgggtgaattccacccattccagggtcggagcctctatatcactgggtgaaaaccagtccgcctgggcataaatatgagcgataatattttccttataataaatcttctgaagcccttcctcatagtccgccacccagcgcctggtcttcaggcaggccgccgttttggcaggctgaatctggtttccggcaaacatgagggaatgggttctgtccagctcctccggaagcttgatatataattcacggaaaacctgcttaaaaggctgcttcttctcctccgcaaacagcttcttctggtattttctccagcagccagcttcgtaaaagtccgcaggatgcgccacccggaacagctccccgccttccggggtcgtacatttatcttcccagtcatacagcccttccgccttcaggaacccaatcgccgggcttccggcagattcttccctttccgccccgataaacacaaggctctgcactaccggcctcgttacgggattttcacaaagagcctgcagttcctcataccggtaagcttctctctcctccatggcctgttcaaacattttcacacacctggaatattgttccttaagcttcgtatggatttccttcagctgcagataataggcgttcttcttcaagccggccggtacggattttaaaggttttccggctttttcggccgcaatcgacggccttccgttttcatccacctttagctgcagaaagactccgtcttcctcttttttatcaaaataaggacggtattcctttaccagctctgtttccatggcaagggtaaggcgtgttacatccgcaaaaccggccctggtggccatatttttcattgccaccgatacggcgagcgcttcgctggcccggcgctgtgcgccgaactgcctgctgtccttccgaaactgctgcaggaattcataccggtgaggaaactccctcctctccctaacaggcgccagaccatagctcatcagcaggtctttattccttttctcccggattaccggttccatttcctccgccgtaacccggcccagggcagcatccgcatattttcttgcccgggcatgcttgcttccgtcggaaatatatttggcggcatcatacagcctgtcgaagcgttccttgcccagcagcgcatacgcctcttcaaaccagttcaaatcaaaggctccgttattgagttcttccggggaaagcggcgtataccgggctatcatcgccttctttttatcatcaaatcgctcattcatatgggccatgaaataatagcagccgcttttcagcccgggccagcccaggtattcttctataatatccagccactggggcgcgtacatggcagtttcaataattttctgttcctttattttggttcccttcagcagggccttcagctttccggcatcctcgccttccagagggtaacatatctgaagcagatagctcagacactcccttttccctgtccggctccccgaccagtaataataagcggaccgatccagcttgtcatttcccagagccttcagtatatcaatcatacgctccatgccgtaaatacgcttgatagaggatatactggaggaaaacacagtgggaagatcccctctcttgagttccacatccagaatcgtatcggtaatacggaagaaaaattcctttccctgcttcacaaagggattctccggatttactttctcctccgcaagctcttcctccgacagataggcggacagcctgtttttatcatagggaagcagccgttccgaaacaagacgtgacagatcctccagggaaacgccgaggcctatcgtttcaaaagccgccttgtaaaccgtatccgcaggaaccagtcccagctgaaaggccctgatatattcataaatggtcagcagggtacgggaattacggttataagagtaatagccggtactgctatgggcattatagtcaaaaagctgatccagacggtacagggcaaaaaaaccttccttgaattcttcctctgttttccacactgccagagaacggatcatgctgttgaccgcggtaatatccgtcagggcaaattcaccgggatccgatacatagtaataccgggtatcctttattttctcgtaccacaaatcctccgcgggaatctcgtccgctatcagcgccgccatttccagggccgcacaacgtccctgcgtctccccatatatgctgttcaatatggtcagcactgtgtgcgggctgtttccgtatccgtgctgtacaccctgtttctgcggtattctgaattttacgatatctcccaaaagcattttctcgtaccggagcagcgtctcctgtctcttcaccctgtatccttctcccagtccgttgctccaggccagaagaagaagcttaaccagatggggatccccgatatgctcctgataaaaacggatccaaagctctttgaagggataacggtccgccaggggaagagaggcatcatggctgatcatgaccaggtgatttcccaaaagcatctcatagccgtttgcagccttatattccaggtccgcattttcatccagcagtgcgtacaggctgcggatgatttcctccagcctgcccggatccgtacggaaataagcccggagattctcccttccctccgtcggcttcgggcacacaggcttcacatccttccggtacaggccatacccttccgtttccaatatctggctggaggacgattcgcctctgacctcctccaaaagaatctgttccttatccgagcttccttccagctttccggcctcttctgccagtctctccagcagttcttcggatcttcccctgatccgtgcctctctcaccaaagtaaggccgccctccctgacagccggcaggggagacgccagcagccgcttcactgattcctccagtcctttatcctcctgtttttccagcagcttaaggacattctgcctgatatcttcttttttatacttcaaaagcccttccagctcccggtaatccacatcggataattccagctcctccacaagccggaaagccgtctttctcgtcatcgtttccttatcccccagaaaagaaagcagcagagccttctgccgttcattttccgggctgtgaagcagcagctccacccatttcgaccggctctcataagtaccgctgatatcgatttccatcacttttccggcagcatcttctatgaaagccgaatcttccagggcatatgctatcacacacatgcgtttgataagctgtcctctcgacagttccaccccataccacgggaaaacacacggtacaaattccagcttctttttcttcatgccttccagcaggctcttcagcacgccatagtgctccaaagcctcctccctgctgccgaacaaccagttaagaggaatcggcatgtatgtcttttctcctgtattccccggcctgctgccgccaagcgcatatctgacatactcctccaccccgctcagataagtgggcataaaggcagccaccatctcaggatccgatgcaaactgcagtatggccttcctcgccgtaatccccgtaaacgcttcccattccagagtacggttaaaataagacatggtcaggatttggtttctcgttccatgctccagaaactttcccatcaccccaatggcatcctgcagctcataaaaggccagcgtccacagtcctatcccaatccggatgctgtcattgctgcttatataagcctgtgctgctccgggatcgttgagagcctccttcatgagaacaagcattttatccgagatgcgatccgcattttccacatcgcagattcccgtccagacagccaccgccctttttacagaggcgaagcggatcaagttattctcacatacggcggcaaaaatcgtctgaaaagcttccacggttccgcagtccgcattttcacagatcgcctgcctcactccctcctgaagcctggccgcaagcaggaaatccgaaaggagccggtgaaggggcgcactggagcttttgataattccccttattaagtcaacggttatgaccgcagtattgttgtcactcagcaagatatccttcactgccgcagtcactgcctcatctcccctgtcaatcgcggccgcaatcaaatcatccagatactgcatcgtaaaaccgtaaaccggatgtctcttatagtccagcttttcctccggcagccgatccagcagataatccgcaagcgtgcactcataaaaattcatcacccggcatgcatacagcagccggaagacatgctccaggcacggcaaatacgatttggtgcgcaccgatctgcggtaaacactgtgggaatagggaaactggttaaacttatcaatgatataataaaagtcctcggcgaacgctttgcccgcataaaggtcaaccagctttttatattttttccgcataaattcggaaggcgtaaggaaaccctcatcgccaaacttcgcctccaccccttttaagaaggagtttacttccggcctgtactgtccgaatttctccatctgctccatcgcttctttggtatccccggaagcaagaatcagcttccttttccattttcccttataagcttccacaagcttctgtctgctttgataattatattccatccttctgcctctccctgtagctgctaccacattcttcctgccagcatcgtcatccttacaaatacaagttcactgttttcctgaaggcttattttttcctccagtctttccagctttttcccgtccagaaacaccacagctatcccatcttcaaaacactggcatgcgttctccgctgcctttcggtaatccggcaccttgtcctgaaaagaaaggccgaaggttatctttccggcgcccgcctgttcttccatgctttcctttgacagcacggcctccacctccgtatgcctgcgcctcttcccatattcctccagatcaatgcgcacagtttcctccagaagccttcgtaccgtatccacgttttccggataatcataaaaaaccggagctatcttactgtggtttttgcccagtttttttacctgaatttttaccttcatatatgtatccacctgttcccatacaccagtactttgcccggctctgacactttctttttattatacaacggggcggtacaggccggcaacaaaaagaaaacaatcagaatcgcaaatccatttttattatttcggaaaagagaatggatttaaccgacacgattctcttgcaagctctcattctatgccttacaatatatgaagtgcattgggaaggagtcatccatgtcaaagaaaaacattcttataaaaaccaatattctggtatgcctgattatcctcgcaggcttcctgttaaccgctatattaagctaccgcgccaactacagctccgcactggaaaatgtggagcagattacagacctgacctcagaaggcatttactaccagctgagcacaatttttacaaaaccggtaaacgtatcccttaccatggccaatgacagcttcctgaaaaattatcttgccggggaagccggacgcctggaggacgacagctatatcgagcccctgaaggaatatcttggcgcctatcagaaaaaatatggctttgattccgtttttcttatttccacagtctccgggcgttattataattttcagggccttgaccggatcctgaccagggataacccggaaaatgtctggtattacgcgatgcttgaggattctgaagattattccctcaatgtggataacgatgaagtggtcaatgccaataatgacatcactattttcgtgaactgcaagatatatgatgaaaaggataataccataggaattattggtgtcgggcttcgtgtagattaccttcagactattctcagggaatatcagaacgattttgatgtaaatgcttatctgatcaatgaacagggaatgatagaagtctcctccgagcattccggatatgagcgcctaaatttatttgaagaaaatggattgacagatatccgcgacgaactgcttggctggaaagaagaagggacatcaaaaagcctctggtcttccggttccgctccttccgggaaacgggcttatgttgtggcgcgctatattccggaaatttcctggcatttgattgtagagcaggatccccccagcctgattgccaaactgcgccaacagctttatcatacggcagtcgccatagctgccatactattgatcatcctgtttgttatcggtttcgtcatcggcaaattcaacaagcatattctcaggctgacccaggaaaaagaagaagccttccgaaaggcaacggaacagctttatgataatatttatgaactgaacatcacacaaaaccgcgccgccggggtcagtacccagagatactttgaaagcctgggtgtcccggccaataccccttatgacaaggcgctgcgcgttatagcggaaaaacagatcaaggaggaatatcgggaaggctacatttccatgttttctccggaaaatgtcatgaagaattacagaagcaataatacccatctgcagtatgacttcatgataagcctggatgactccggttatttctggatgcgcatcgacgcatatatttatttatgtacggaagatcattcgatccatatgttcacctaccggaaaaatattgatgcggaaaaacggcatgaactgaaaacggaaaagaaaatccagacggatgaaatgacggggcttcttaacaaaaccgctaccagacagcatatcagcgccgccctcacccttaatccggaaaaaaagtatgcttttttcattctcgatattgataatttcaagcaggccaatgatttacatggacacgatttcggcgattatgtaatcatccgttttacagatatcatgaaaagcaatttccgtaccgacgatatactcggacgcatcggcggtgatgaatttgtggtttttattcctgtaaatgatctggaatcgaccgaagcaaaagccgaactgcttgtttcttccctgagacagacctgcagctatcattcctccagctggaatataacctccagcataggtattgctctctaccctgatgcgggaacggattttgataccctgtataaaaatgcggatacggccctctatgaatcaaagcggctgggaaaaaacagatattccttcttccgggaatagcactgtcagtgcagctttttttccgcctgcataagtccctgttcataacggtcgatcttctgattcagcctgtccagggatttctgcatctcctccatcctcgccagcagctgatccctctgttctatgagcagcatttttctggcattgacagtggaatcgccctgctggaacagagacacatattctatcaaggcttcaatctgcacgcccgctttgcgcatgcacttcatcaattcaatccagcggcaggaattttcatcataatccctgattccgctcttatttctgggtacctggggaatcaggccgatacgttcgtaatacctcagtgtatccggagacatctcatatttcttacttacctctgcaatagtcatgactgcccgcctttctcttaaaaagaatcacttaactctgtctaatcataccaccaggacttaactccaagtcaatcatttttttacaaaaagccccttgcacagaccttctgtttacttttaactgcagaatacttgacagcaaaaggtaagctttatataatgagcatggttcaataggaggaaaaaagatgaacaagaatgttacatcccgtcaggagcttattgacactgccatggaaatagcccgtaccgaaggcatccataaagtaaatatccgcaatatagcccggaaatgctctatttccgtaggtgttctttataactactttcccaacaaaacagagcttatttttgctgttgtgaattccttctgggctgatgtcatacagaatctgtccgggatggtaccacagagcacctgtttcccgcaatttgtgtcccagtattatgccttgataaatgaacagctttctgaattcgaaaaagactggctgactcaattggagaccatgcctcctgaggataaaaaaagaggccgggagctggaagaccaatgcttccaggtgcttcttgatgttctccgcaaggctctccacagggacacctccatttccgagtccgtatggtcggaggaatacacacaggaggaatttcttcagttcgtattccatcaccttattgtccttcttcatgccggacataaaaactgtgactttttcgaaaaaaccctgcggaaaattctttattagccaatcctccgcagggccgttctttttatgttttcctgactctattaaatccgtttatttctgtacccggaattgtacgggagttatcccataggattttttaaacagtctgttaaaatgctccacgctctcataacccacatccgcagctatcgattccaccgaatgtcctgattccttcaaaagcgttctggcttttctcattctggcttctcttaccacgtcctggaaattcatccctgtcttatccttgatatattttgaaatataaggtctggaaagattaaaattctccgacagattttccaaagttacttccgcataatgtccgtttatatatttgataatatccacaactctttcctccctgccttcctgaaaattttcaccttccgccagcttattgcccgctgatacaagcgcagccacagaacttttaataatatcttcatcaattcccacgccccaatacatcttgcccctgcaggaaatccccacataggccgccgctttggaggaagaacccctggaaatcgcatgttcctcataaaccgccagttcataatcgattccgaaatacatcttaaccgcattgcttactgaatccagacggccgttgccggaggcctccaccactcttctttcctttccctgttcgatggttacctgcgcggtaatcccgttttcctggcggaagtggaactccggaatctgaaagaccgttctgggtgaaatataattttccttgaaaatctgataaatgtccgccggagccagctcctggtgacgcttatcggaaactcccttcaccaaatacccaacctcttccttcattccgtccggtaaggagaacccaaaattctgtttcagaataaaagcgatgccgccctttcccgactggctgttaatccggatgacatcggattcatactctcttcccacatccttgggatccaccggcagataaggaaccgtccatttacttccgctttttccctcattccgccaggccatacccttggaaatcgcatcctgatgggaaccggaaaacgcggtaaataccagatcccccgcatagggcgttctttcatccaccttcataccggtcaaaagctcgtaattctccctgactttcataatatggctgaaatccaggccggattccacgccatggcataccatgttcatggctaatgtgaccagatccacattaccggttctctcaccgtttccaaaaagcgtcccttccactctgtccgctcctgcaagaatcccaaattccgcatcgctgattccgcagcctctgtcattgtgaggatgtacgctcaaaaccacgctgtccctgtatttcaggtttttatggatatattccacctgacaggcaaacacatggggcatcgctacctgcactgtagtcgggatgttgatgactgccttgtgcttctcatccggcttccatacatcaagaaccgcattgcagacctccacagcataatccacttccgtccccgggaagctctcagggctgtattcaaatgtgaaattaccgtccgtttcttccgccagttttttcaaaagagcggctccgtccaccgccagctgtttcacttcgtccttactctttctgaaaacctgttcccgctgtgccaccgatgtggaattataaagatggacaattgcatgcggagcgcctttcactgcttcaaaggtttttctgatgatatgttccctcgcctgggtgagaacctggatcgtcacatcctccggtatcatgtctctttcgattaatgcccgcaaaaatgcatactccgtatctgatgccgcaggaaatcccacctcaatttctttaaaaccgatttctaccagcatcttaaaatattccagtttttcttccagacccataggctctataagcgcctggttcccatcccgcagatccacgctgcaccaaatgggggccttctcaatcgtgtccttcttcacccaatcatatgtcaccaccggtggcatgaaataggattttccgtacttttctgctgctgtcatttatgcttcctcctattctgtccgggcacaaaaaaagtctctataaaaatgactttcctgtaatccgggtcatttttatagagacgcaaattcaacttcacgcggtaccactctatttcatggtaataaaaaccatgcactcatcagcactaacatgcctttcccctttctacggcgggtattccgtccgaacctacacaacccttcgggtcttcagccggctgctccaaggtcagttcacggtccgcttcagactgcctcgcaccacccggcagttctctgttttccagctttcagctactactcctcttccttgcatttgctttcctattcagttttgtaaataataacacaggtttgtggtttacacaagatgcaattttaatcaatttgattgatttattttaacctgccttatgaaaccgcagcagccagggccctgccaagctccttacatttctcttccgtttcctcatccggtgccccgtttacaataattccttcttctccaacaacagatgcgccggcatttcggactctttcttcccagtccctcatccattctcctccgccccatccgaaggagccgaacaggccaatctgcttaccgcctattccattttccaaatcacacataaaaggctccatctgcgtttcctccagctgttctgcccccatggaaggacagcccagcgcaaaagccctggctttcttcaattccgaaacatccgccagatccacactgagcacgacagcctcctgtcctgcttccctgacaccctccgcaaccttctgagccattaactccgtgttgcctgtgccgctccaatatacaatagaaatctgtgccatctttattcctcctactttatataaaatgatttatatggatgtacatagctgcagaagctcttttccttccaatacctcccggacagttacttccctggcttcatcaaatgcggcaaaaatatgttttgcacgctgctcattctgatataccttccagtaacccgtacacagacagtccctgccctcattggcaataaatccttccacatcctctatgggatatccgagaagtactcctatctcatgagggaaattttctttcgtcctgtaataagcctctactctccgggacagttcggacaaaatccggcagattgaaaaaggatgtatcttgccgctctgcaggtatcctctgtttttcagaaaggctgaaacatcctctttctgcagcaatctctccaattcctttttccggtaaataaataccatatcttttccatcttcatggagcagaaaataccagtttaggccggtcctggccgccagtactgaaaattcaacggcctgatctcttggcagactgactacagcgctttccttaattccttttaaaaaaggagcacaatgaattgccaattgcatatgtaatgcctttttacagctccgcctgtttgtttgtaaatactgtgtgatctcttctacgggcatgctttctttcctccgggatccggaaaatcatcctccggcgcccatccatacgccggaaaataacctccttttagtacatgtcaggtaatagttagtcttatctaacttcaagatatagaataccacaggataccatccgctgcaatatggttacttgataagatatatcaatccttccgtcagacaaaaaatccccgtttccgtcagtgcttacagactgaaggaaacggggactgtcttaactatatgattaccggaatgctgttatttataatttacaatctttccgaagtcaggcttcagagctgcgccgcccacaaggccgccgtcgatatcaggctgtgcgaacagttctgcagcggttcctgcattaacagatccgccgtactggatacggattgcttctgcagtcgcttcgtcatagatttcaccgatgcatacacggatggcagcacaaacttcctgtgcctgctctgtggttgcagttttgccggtaccgatagcccagatgggttcgtatgcaataactgcggttttagcctgctctgcagttacacccaagaaagcgattttaatctgctgacggatccagtcaatggtaattccctgctctctctgtgtaagagattcgccgcagcagacaataggagtaataccatgctcgaaagccttgagaactttcttgttgacagtctcattggattcagcaaaatattctcttctttcggaatgtccgatgataacatattttacgcctacgtcagtgagcatatcaggagcgatttctccggtatatgcacctttttcttcatagtacatattttctgcaccgatttcaatattgcttcccttagctgcttcaatagcagggatgatatcgatagcaggcacacagaaaacaacatctgcatcttcggttgccacgaggggctttaaggtattgattaattcaacggcctggctgggagtcatgttcatcttccagttgccggcgataattttctttcttgccatgataatggtctccttaaaatttattatttatcgtttgctgctgccactccgggaagttccttgccttccaggaattccagggatgctccgccgccggtggagatatggctcatcttgtcgccgtagccaagctggttaacagctgctgcggaatcaccgccgccgataattgtggttgcatccgtttcagccagagcctttgcaactgcgatagttccttttgcgagcacagggttctcaaatacgcccatcggtccgttccaaacaacagtctttgcagtcttaacagcttctgcataggtttctgctgtcttaggtccgatatccaggcccattctctcagccggaatggaatcggcagcaaatacttcaacttcgatttccgcatcgatagggctggggaaagcttttgcaacaacagcatctacgggaagaaggaggctcttgcccagcttttcagccttttgcatcatttccttacagtattcaatcttttcatcatccactaaagaagcaccgatttcatagccttttgccttcaggaaggtgaatgccataccgccgccgatgatcagggtatcacatttctcaagcaggttggagataacattcagcttatcagcaaccttagcgccgcccagaatagcaacaaaaggtcttacgggattttccactgcatttccaaggaaatcaatttccttctgcatcaggtatccaactactgcggtatcaaccagctgtgcaacacctacattggagcagtgtgccctgtgggcggtaccgaaagcatcgtttacaaaaacatcacacagagaagccagttctttggagaaggcttcgccgttctttgtctcttctgctctgtaacgggtattctcaagaaggataacatcgccgtccttcatggcttccacagcagcttttgcattggggccaaccacttcgggatccgctgcaaacttaacttcctgtccgagcagttcggaaagacgtgctgcaacaggcgctaaagacagctccggcttcggttctcccttaggctttccaagatgggagcagagaataacctttccgccgtcagcgatcagctttttaatggtgggaagagcagccacaagacggttctcgtctgtgattttgccctctttcagaggaacattgaaatcgcatctgcagaggacacgtttaccttttacgttgatatcatcaacggatttcttatttaatgacatggtataaaacctccttaaaattaaacaggggcccggccctcatcagaccggaccccttatgagcctatgcctttacacagctgactgcaaaattataaattaagcgttcagcagtttgccaaagtgtttgattgtacgaaccatctggcttgtgtaagaattctcattgtcataccaggaaacaacctgtacttcagatgtattctcgtcaataggaagaaccatagtctgagtagcatcgaacagggaaccatatctcataccgataacatcgctggatacgatttcgtctgtgttgtagccgaaagactcattggcagcagccttcatagcatcgttgatagcttctttggtaggctgtcctttaactactgctgtcaggatggttgtagatcctgtaggagtaggaacacgctgagcggaaccgatcagcttgccgttcagttcagggattaccaggccgatagccttagcagcacctgtgctgttgggaacgatatttactgctgctgcacggcttcttctcttgtcgccctttctctgaggaccatccagagtcatctgatcgcctgtgtaagcatggattgtacacataataccgctctggatagggaaagcatcgttaagagcttttgccataggagccaggcagtttgttgtacaggaagcagcagaaatgatgtgatcatctttgctcagtgtctcatggtttacattgtaaacgatggtaggcagatcgtttccggcaggagcggaaatgataacgtgcttagcgccggcatcgatatgtgcctgagcttttgctttggaggtatagaatccggtacattccagaactacgtccacaccgatttctccccaaggaagctctgcagcgttagcctttgcataaatcttaatttcttttccgtctactgtgatggaatcttcactgtaggaaaccttgtcgcccagttcatatctgccctgagttgaatcatatttcagtaagtgagccagcatctcgggagatgttaaatcattgattgctacgatttcaaatccttctgctccgaacatctgtctgaaagcaagacgtccgatacggccaaaaccattaattgctacttttactgccatttttaattcctcctaaaaatgatttaatatattattttgtcaagcgtagcaaacggacccgcgcacagcgcaagtccacattccggacacaccgaaagcttacccgggcttgtccccatagcttgacaaaattttatcagcacaatcattttacctaatttacaatgaaatatcaagacgaaaattaaaaaatattggaaatagtgccttattttacagaaagtttataaatagcatccattcagcctgttctgaactgctgaagttcatactccattttttctttgccttttcctattctataggctatacttttatttggtcggtcaaatcataagaaaaagcagcagggccggatccccgtcggaaaggcggcactgctgctgttattacgaagaaaggcggcaaatatggctatcaaagcagattttcatttacattcttctttttccggtgattccgaggcgcctatggaggacatgatacaaaaagggatttccctcggcctcacccaaatgtgttttacggagcatatggattttgattttccggtttcccaggatacccccgccggtttttttgaagtcaacactgattcctatctgtatgatttgctgaaatatcaggcgaagtaccgggaacagattcagatctttttcggtatcgagctgggactgcaggcttatctgaatgagctgcagagcgcttatacgagtgcatatgactttgacttcattattggttcttcccatttatgcaatggcagggacccttataatgccggtttttatacgggacggtccgaggaggaggcttacagggaatacttctcttctatcatagaaaacctggaaaccttccacgactttgacatatacggccatctggactatgtggtacgctatggcccgaacaaggataaaaattatacctatgaaacctataaagatttatttgaccggatgcttgaccttctgctggaaaatgggattggcatagaaataaacacaggagggattcgttatggcctgaaggagcttcatccctgcatggatgtattgaagcgctaccgggaaaaaggcggcgagctcataaccgtaggctccgatgcccaccggcccggagatatctgcagggaattcggacgggcggaagcgctccttagggactgcggcttttcctactatgccgtattccataaacgaaccccttccttcaggaaattatagccttcctctctgcggcttcacggctggtttgggcagcgtcttaaacattacgctactccgactgaagccgtctcaatgccaaaacacatatcgccgcacacacagcaaagataacagccagcggaaacaggctgctgcatacggaaccgtcacctgtcagcagccggtatccccaggctgcggggaatatgctgccgatgactgccaaaggccggggaagcagcccggcaggaaacataatgccggaaagcatgatggacggcagaaatgcgatttgggaaaccatagtgagttttgactgattttttaccgacagccccagaatactccccaggcttaaggataccccaataaaaattgacagccgtataaaataccacagcggcctttccggaagctgcgcgtcaaatgcaatgggagcggcaatatatatgatcaggcacatgagcatcaaatggagaaatgccgacagggaaatggtaaacagccccagataaagcggtaccccattagccttgtacactttcttgatatcgctcccatatatctctgtaagggaaggcggaaggcctaccagcgcccccatggatacccccattacagtcatggactgtatcagtgtactctttgcctccggcatgagtgaggtaaatattccccccataacggcaaaaaacagcaaagggacaagatagcaggtgatcagcagcgctttgctgcgtatatccagcttccattgcagcgccgctccatataaaaatgcactcattcactgtccccctttgcaatttccataaaatgctgttccaatgtccctctgtctatttttatatccatcacttctgttcccttcttcctgaattcctccagcgtctccagcagagccgccccgatattttccgtttccaggcattcttctcccttactggtcttgatatggatcctatagcgcctgcttattttttccgtcaatccagctaccgtccctaaaaatgagacattaccagaactcagaattgcaatacggtcgcaaaggctctccacctccgccatatcatgacttgccagtataatcgtctttccctgtgttttcagtcttcgtatctgctcatgaagcgatattcttccttccacatcaagcccggcagtcggttcatcaagaaaaacaatatccggatcactgaccagcgcaagggcgagatgcagacgccgtttctgtcccgttgacatatccgcatattttttcttcccaagctccttgattcccagcgcttcaagcatggtaccgtctgttttcgtcttattccatttcgcgaataaacgaacagcttccatcgcccttatctgctcgggaagagaagacgactgcagctgaattcccattctgccgttcaccgcaatactgccgccctcaaatttccgcagcccttccatgcactcaagcgcagtggtcttccccgctccgttaacacccagcagtgcgaaaatttctcctcttgcgacctggaaactcaagcccttcagcaccatatggttcccgtagcttttcttcagaccgtcaatctctatggcataactcatctgtttcccccctcaaacggatcatatcctgtttttgtaaaataagcctccagagccggttcgataaaagaatgtacaacagcctgcttattcttccattttccgcccggatcctccaatttttccgtttccataagaccgggaatcaaactcatatctccatccgtaaattccataatcatatcccaatatgcctctgcaagctccatgcctttctcactttcaggaacctctccgctgttctgaagacgcaccgcttcctcctgcagccgggtgaaagtttccagcatagcctgaccgctgtctttatcaaaacgtccccggaaacactccagcgccctgtcatccaaattctttatcagccagtaatactcattcttcatctgcagattcacaacaatatcagcatatttgccgaaatccaccgaatgcatctgaagcacctcttctctcagagcctcaatagctttcagcgattccgacaggctttcaatcttttccctgagagccgccgcctgtttggaaagaacctccgccacatcccccggagtatcaagcggaatcagacggttcttaatatcatccagagaaaaccccagagacttcattgacaaaatctgatgaagcctgaccacatctttatccgtataaagccttcgcccgccctcactcaccgcagtcggagacagcaaaccttccttatcataatactgcagcgtacgcacagttacgcccccctttttcgcagcctgtcccaccgtcatccacccccgcacctccactctcctttttcccataaccatcacctcctcccccattataattcattacgccacgtcacaagcaagcgcttttatatctttttctttactccctctttctgcgatccataactgcccagtgccccttgtcttccgccagcccttcccttttgccctgccgctgcggattgcctccccggtggatttgtgtaccctgcaaaggccttctgaaaacgccggtccttagattgcgtcctctgcaatcttagtaccgctgcgttttcagcagagcgaaagcgtgcctgcgcagggtacacaaacccaccgggaagacaatccgcagcggcagggcaaaagggaagggctggcggaagacaaggggcactgggcccacacactatctgcccttacgttcctactgcccgcaaagcacaataattttctcaggcgtagtctgtgccggaatactcctggttgtctggctgtaaagcaccaccagcgtatggtttccgggattgcccatataagtctggttatttgtcgtcattacctgggtggtaggagccaggttcagcttcaggctctgatcactgctcatgagaaggttgttaaaatatcccacaaacaccatctgcccctcctgctgaggcgcgatcacagcggccacatactggggagggtaaatcaaaggagccgctgcatttccgttataaaacacggttaccggcatagtctcatacaaagtggcataatccaccacaaaggtatccggattgaaaaggaaattcacggtattccccgcttcattttccacggtaagcatctgggcgcaggcgtcgtagtttcccatgttacctcctgccacttccatatgggtgatcacaccggtaaacgacataaagacaggacgctgcctcattccgaaaaactgattaaaattagtatccaatttcttgtttcctttatttatctttctttataattatgcaaaaaaagaaaagaggtaccatcggcctcttttcctgcttatgttcttattctattgttcctccgccgagaacgtattccccatcgtaaaatactgcggcctgtcccggagtaaccgcccttaccggctcctcaaaggtacatttcactctgtcctccccgatcttttcaatcagacagaaagcgccctgatgggcgtaacggatttttgccttcactctcatgggttctgtcaaatcgggaaccgacataaaattaagccggctgcatgtcagggtgccggtaaacacatcctcgttttccccgatcaccacttcgttggtttccggacggatcccggtcacgaaaaccggatgccccaaggaaagattcagccccttcctctgtcccaccgtatagtgggtaatgcccttatgcttacccaggattttcccatcagctgaaacaaaatttcccgggccgggtaccgttttcccgctttctctctcgataaacgcggcataatcatgatccggtatgaaacagatttcctgactgtcctttttatgggctacaggaaggcctgcttcctccgccatctgacggatctcatccttcggataggctcccacaggcatcagggtatgggccagctggctctgggtcaggttgtaaagggcataggtctgatctttggctgcagtcacggaattacgaattgcaaaccttccgtttggcagctgctcaatcctggcataatgtccggtcgcaatatattctgctcccaggcccaggcttttggtaagaagtgattcccatttcacatacctgttgcaggcgatacacgggttcggcgttcttcccttactatattcttcgacaaaataatcgataacattttcctgaaattcttttttgaaattcattacataataagggatatccagccgctgcgccactcttcttgcgtcatccaccgcactgagcccgcagcagccaccgttttcttccttgatctcttccgcttcatcctgccaaatctgcatggtaacgccgataacgtcatatccttgttttttcagcaaaagggctgccacagaggagtcaactcccccggacatgcccactacaacttttttgcccatattttagtattcttcctctgcttcttcttcaccttcatgaatatctgacttgggtttatccagcccatcaatggtaatgccgttcttctgtgcataatcccataatgcggcatgaatagcttcttctgccagaagggaacaatgcactttaaccggcggaaggccgtccagagcttccataaccgctttgttggtcacctccatggcttctcttacactcttgcccttcaccagctctgtagccatgctgctggtggcaactgcggctccgcagccaaaggttttaaactttacatcccggatgatgccgtcatcgtcaatatccaggtatattctcataatatcgccgcatttggcatttcccacggtgcccacgccgctcgcgttctctatttcccctacgttgcggggatgttcaaaatgatccattactttttcgctgtacataatttttcctttctataataactgcagccggcagtcgcttttgttaattattcttattttttttaacaaaatcttcgtaaagaggggacatatcccgcagctttgtcacaatttccttaattgcttccactgtaaaatccagttcttcctttgtattttcctcattcagggacatacgcagggatccatgggcaatctcatggggcagccctatggcaagaagcacatgggaaggatccaaagatcctgaggtacatgcggaaccgctggaagcacatattcctttcatatccagcattatcagcagggactctccctcaacaaaacggaaactgaaattcacgttattaggcagccttttttcccggtcgccattcagacggcaataaggaatttccgattcaatacggccgatgagataatcctgcagctcccgctcttttacggtcttttcttccatcatggaaaaggctctttccacagccgctccaaggcccacaatgccgggcacgttttccgtaccggcccttctgcctctttcctgctgtcctccatggatgaaggaacggattttgatccccttccggatatagaggaaaccgatccccttcggcccattcagcttatgcccgctggcactgagcatgtcgatgctgcattcatccacgttaatcggaagctgtccgtaggcctgtaccgcatccgtatggaaaaggacattatgctttctggcaatttccccgatttccttaatcggctggatcgttcctatctcattgttggcatacattatggaaatcagaatggtatccggacggatagctttctcaagctcgtccagcttaactataccattttcgtccacatttacgtaggtgatttcgcagccatttttttcaagatattcacaggtatgcaataccgcatgatgttcaatcttagatgtgataatatgctttcccttggatgcataggcctctgccacagccttcagcgcccagttatccgcttctgagccgcctgcggtaaaataaatttcattatttgcagctcccagagtcccggctatggtctccctcacctggctgatcgccttcttgctttctgtcccgagggaataaatgctgctgggattcccataattctccgtgaagtaaggaagcatagcctgcactacttcaggtgcggttttcgtggttgccgcattatccaaataaattatccgactcatataaaactctcctgactgcatgttttcatgctttttctatatttctgcagctcccgggaaccttaattcctagtaaaccacttcgttttctatggttaatataacaccgcacctgcgttctgtcaacaggctctcctgcatatatttaccaaaagagctattgctacagattggagcagcatgcgcatcaaaaaaaataccctgatcaccggaacgatcatcctaacaataacaggtcttggcagccgccttatcggtttcttctaccgtatttttctttcgcggctgttcggcgaagaaaatatgggaatttaccagctgatcggaccggtcatggctcttgtcttctccctttccgcagccggactgcagaatgccatctccaaattcgtggcaggagaaacagccactcatgattataaagcatctttgcgcattttgctagtgggttttgcattctcccttattttatctttgggctgtttgttcggcgtataccatttttccgactttatcgccgcttatcttctgtttgagccgcgctgtgctccccttttgcggatagccgccctgtcctttccctttgcttccgtccattcctgtgtcaacggctatttttacggaatcaggaaaactgcggttcctgcagccactcagctgactgaacaaattttcagagtgggaagtgtgtacctgatcgcttcctggtgcctgcagcagggaaaagagcctactataaccgttgctgccgcaggccttgctatcggagagctttcatctatgcttctcgcccttcccgctgcttacctgcattttatcaaaaaggcttatcccgccggacgtctcccttccggcacgctgtaccgcaaggccgccggatccagcaaaaccgggctgatacgggtatatggaagattgagccgacagatcatcggttttgccgcaccgttaagcgccaaccggctttgcctgaatctgctgcaggccatcgaggccgcctgtattcccgccaagcttcaggtttacggtcactctgtcagcgattcactgagcgtttacggcgtacttaccggaatggcgctgcctctcatttattttccgggcaccctgacaaattcggtttccgtcctcctcatgcccgccatttccgaagcggatgcggtcaataaccagaacgccataaggagggccgtacgcaaatgcctgggctactgcctgcttcttggctgcgtctgctgtgtcggttttttagtattgggaaaaactgtgggcattatgctttataacagcgaaatggccggccattttatcatcatactcagctttatgtgtccctttctttatctgaacaccacgctgaccagcattctccacggtctgggaaaaaccagctattcttttttcttaagtctgaccggtctgatgctgcgccttgttttcgtcttccaggcgatccccttatacggtatcaagggatatctggcaggcatgctgttaagccagctttatactactgtctgctgccttgtcccgctccgtcagtaccttctgccctgataattgtccccgttcacgccggccctgcgcctcgcggctgccgccatcctctctgcctttccggagcggattcccctcccggcgggtccgtaaaccctgcgcgggatccgttcctgcgcttgcactttacgtttttctatattataatgtacgcggacagctctaacgggactaccgtacgggctgtacctaccgaaagctgtccggcaggtttattaccggcctgcccggtttttattttacagacaggagaaaatgcgccatgagtttcgaattcataagaaaattacccaccccggatgaaatccggaaggaatatcccatgccggaaaagctcgtccgcctgaaggaagaaagagatcaggaaatccgcgatgtaatcacaggaaagagcaataaattccttgttattatcgggccctgctccgcagataatgaggacgccgtatgtgattatatctccaggcttgcccggattaatgaagctgtcaaggacaagctgatcctaatccccagaatttatacaaacaagccccgcacaacaggggaaggctataaaggtatcgtacatcagccggatccggaaaaaaagcctgattttcttcagggactgatagccatgcgtaaaatgcatatacgggctatcgaagaatccggtcttacggcagcggatgaaatgctttatcctgaaaactggcgttatttgtcggacatcctctcttatgtagctatcggtgcccgttccgtagaggatcagcagcaccgtcttaccgtgagcggttttgatgtccctgcaggaatgaagaatcccaccagcggtgatttttccgtaatgctgaattccgtatatgccgcccagcatgcccattcctttatttaccggggctgggaagtcaataccaccggcaatgagcttgcacataccgtcctgcgcggcgctaccaacaaacacggacgcaacatccccaactaccactatgaggatttgaacacacttctcactctttataatgaacgggatttgaaaaatccggcctgcatcattgatgcaaaccacagtaattccgacaaaaagcaggaacagcagatccgcatcgtcaaggaagtcatgcacagccgcaagctgaataaagatatccattcccttgtcaaaggcgttatggtggaaagctatatcgaagaaggctgccagaaagtaggcggcggtgtttatggcaaatccattaccgatccctgtctgtcctgggaggcctcggaacagctgatttatgatattgctgaatatgaataaacaagggatgccgcgtttttcgtgttatcttttgttcaaaaaaacagctgtccgactgcgacagctgtttttttgctttcgattatgattatccttcccagtccccggtaaggcgcaggcctgccgtatccgctaccggcagagaaaatacaatggattttgccttactttccatacccgccttttccattaccgctttcatgatatccttctttttctcggtcctggctacaataaaggtaatttccttttccgacgccagggaaactcccaggaatttttccgctttttccattcccgtgccctttgcatggattacggtaccgcctcctgctcctgcttcccttgcggcatccataaccatattcgtatatccaaagtcggaaaccactataacaagttcatattccgtatccttcaatactgcttcctcctctttttcaaattcctgtcccgccagcagaaaccggagtgacttctgccctcccatgctgctcaccggtacaataaatgatatacccgtacccggaacatctatattcagcttcgtttccatgcctttttttacatgtttccagacatctccggtcaccgcggtaaaaagcacaattttatcactttcctccaggcccagacaatcaagcacttcactgcttgcagtcccttttcccagagcaaccagaatgacaggaatcttttccgacttatgcatggaagagaaccgttccccctgatcacgtccggtgatggtcaccatccaatatactttactcatatacttttctcctacaaatctatgatgtcataatctccccataccgcttcttcagcaggaaccgcagcaagcttggcttcctcgctctccgctttccgtgcacgcagctggaaaaccagtccgagtatctgaatggttataaggggagtcatagccaccatagccacaacgccgaatgcatccgcaataatattccctcccaccgacaggcaggcgcccatggcaaagggaagaagaaaggtagccgtcatcggcccggatgccactccgccggagtcaaaggcgatggccgtaaatattttaggaacaaagaaggaaaggacaagcgctatcagataaccgggaacaataaaccagaggagcgatatgcctgtgagaacccggatcatcgccagccccagagaaaccgacacacctaccgacaagctcagtcccatggctcctgaagaaatagcaccgtccgttatctcttccacctgtttggtcaaaacaaagaccgccggctccgcccggacaatgaaatatccgataagcattcctatgggaacaataatccaccgatacggaagccctgcaataactcttcccaaataattgccggcaggcataaagccaacatttacccccgtaaggaacaggacaaggccgacatatgtatagacaaggccaacgcctatctttatcaggccttttgccggtaccagtttaaatattatctgaaacaggaaaaagaagaaaactatgggcagcagagaaattgccatctctttcagatagtccggaaagccatgctgaaaatacctccacagctccacagaatccgatatttcgggtatttccacagggatataatcgccgcctgacggacgatatatcatacccagcaacattaccgccaggatggggcctatggaacaaagagcgaccaggccaaagctgtcatccgaagcatgccggtcacttctgatggaagatataccgatacccattgccataataaaaggcaccgtcataggacctgtcgttacacctcccgcatcgaaggcaattgttaggaaatccttaggaacgaaaaaagtgagaataaatatcagtccataaaagaatataagcaatggaggcaacgctatgctgaaaagcatacgcagaagcgctactaccagaaaaacacccacaccgcaggccaccgacaaaatcagcaccatattgggtatggaaggcacctgttcagccaggacctgaagatcaggctccgatatggtaataatgaatccaagaataaaactcatgggaataactacccaaagcttcttcgattgtgtcatacaggttcccacccgttcccccatatgtgtcatggccatgtccactcccaaagagaaaaataccattcccgccgtgagcagcactgctccaatgaggaaagccatcaatattcccggggataccggagctattgtaaagcataaaagcaatacgatagcgattacaggcaatacggcctttactgtttcctttaatttttcctgtagatttttacgaaaaaccttcaaatatattccgcctttctgctttgccattagctgatacatcacttcattcaagttacaaaatacactcattatctgtttattataacacatgtaaacattaataaacagataaaagtgcctttccggccatatttagcattttcttaacacaaaagggaatttaaaaaggattccggatcttctaccttaccggcttctgggatgagtcctctgatacacattccttaactggtttccgttcctgttggcatatacctgtgtggaggaaatatcagaatgtcccatcatctcctgtacactatggagatcggcaccgttttccaccagatgtgcggcaaaggaatgccggagcgtatgaggcgtaatatccgcttcaatccccgccttccgtgcataaatcttaatcagcttccagaagccctgacggctcatgggttttcccgagcaattcacaaacagggtatctccctcatttccttttgtaagctgttctctcgcttctttaagatacagagtcagcgcttctttcgctttattgccgaagggtaccgctctttccttcataccgtctctgcagataatatatcccagacgcagattcagatcggacagcttcagggaaatcagctctgaaacacggattcctgtagcatacagcagctccagcatggccttatccctgatatccttgggagcgtctttaccgggctgttccagaagcctggccgcttcttccacagtaagcacctccggcgcctttttttcgattttaggggcctttaaacgctcggtcacatcctcagaaaccatcccctttttaagcataaaatgaaaaaaggccttcacagccgcaatatgacgggaaacagtagccggtgcaaactggtttttctcaagatacagcacgtaggaattcagggaagtctccgttatacgcccaacgtcctcgatcccctgtccgctgagaaaagactgcagcttctgcagatctcttttataagaaagctccgtattcactgaagtttttttctcttcatgcagatataatataaaatcccgtatctcgttttccatgccccattgccttcccgataatcgtttatgtaaaccaattaaatatttaaaaaatattataatcagtttttcgcagaaaagcaatgcgcattttccccgattttacgggattttcctgttcattttgccttaagtactagatatcggtgatcgatattttgtcatcgcaatatatggtaagacttttctaaaaaaagtggaaaattctttgcaggaataccggattaacatagctttcaacaaggcatcctgcaaggagcattcctaatataaaaataagagtgcctgcccggaaggctgtcaagcttccgtattttccggtaccggcgctgttataacgggtgctgcggatacgctcctggaagccctggcaccatcggaaaagaaggaggtatgccggcgccagaagaagtatctgggggaaaatgcctcccataaaaatcaatattcctcttatgccatagcgaatcgataataccgacaggattgtgcccgcacaaaacccggcccataccagataaatacttaccgcaatacttcccactcccgctatggtcagtgcaatcaacagcacagccggtgaaaaccgttcctttaaactgtaaaaaaacagcatggagttatctatatccagcactcccattcttcccacactgtaactgtccagaaaatccgcatttcccacaaagctttcctgcccgatataaataagagcaagtcctgctaaaaaaccggctataaaaagagccaggatccgtccattcaattttgtctcggctaagccgcttctttccatacataaacccctttgcctgcttttttcaatatatgcgcctctgtgtatccacatgcatgcaaaggatcagcctgttatcaattttatttgcttccgtacttggcacgataactcataatcgccgaaatcgttttggaatcctcgatttcacctgcaaaaatcttatcgcataattcatctaccgtcatggcttccacattaatatattcatcttcatccaggtgctgactgccgggtgtcagatccgttgccacataaatgtcaatcttttcattgcagaaagccaccgtggttcttattgtgatcagccatttgatttctcccgcatgataaccggtttcctcctccaattctctggccgccgcttccatggtaggttcctccggcccattcaggccccctgcgggtatttcaagggtataccggtcaagggcattcctgtactgcctcaccatcagtattctcccgtcctccatcaccggaaccacagcagctgctccctgatgtttgataaaatcccactttaccacgtttccgttaggcacctttaccgtatccttataaaaatcaacgatagaacccttatataccagttctctgtccaaacgtttaaactcatccgccattttcattctctcctatcttaaatttttaaaagccctgcaggaatacctgcaaggcttttacatttgctattttgcgtaatctgaaacacggctttctctgataacattgaccttaatctgtccgggatattccaattcagcttcaatcgctttggaaatatcacgtgccatcagtatcatatccgcatctgatacctgctcaggaactaccataacgcgaatctctctacctgcctgaatagcaaaagatttgtccacacctttgaaattgtttgcaatgtcttctaactgagttaatctgcttgtataagtttccagagtctctcttctcgcacccggtctggccgcagaaatagtatccgccgcctgaacaatacacgcgatcaaagtagtaggctccacatctccgtgatgtgactccaccgcattaataaccgttgctgattccttatactttttacaaagttccactccaagctgaatatgagaaccttccatttcgtgatccacggcttttccaatatcatggagcaagccggcacgtttagccattctcacatctaaaccaagctctgatgccagaagtcctgacagctgagccacctctattgaatgctttaaagcgttctgtccataacttgtcctgaactttaatttgcccagtaactttacgagttccggatgaacaccgtgtacgccaacttccagtactgcggattcaccttcctccttaatcatcacttcgacttctttttgcgctttttccaccatctcttcgattcttgccggatggatacgtccgtcaactataagcttctcaagcgcgatccttgctacttcccttctgatcggatcaaaagaggataaaattactgcttccggggtatcatcgataattaaatccacgccggtcaaggtctcaagggttctgatattccttccctctcgtccgataattcttcccttcatctcatcattaggaagctgtacaacggaaatagtcgcctcagacacatggtcagccgcacatctctgaatagctgtaaccacatattccctggcctttttgtctgcttcctctttggccctgcattccatatccttgatcatcacggccgattcatgcttcacttcatcttcaacaattttcaataagtaatcttttgcctgttcggaggttaaacctgagattcgttccagttcctgtactctctgctcattcagcttcgcgatttcttccttctgcttcgctatttcctcttcccttgctgccagcacggattccttcttctcgatggcatccgacttcttgtccacgttttcttccttctgctgcactcttctttcgtagcgctgcacttcagacctgcgttccttgatctccttatccagttcgtttttggcacgaatggattcttccttcacttccagcagtccttctcgctttttggattctgcagtcttcaccgcatcatcaataatctctcttgctttgtcttcggcgttgccgattttggtctcagtttctttcttcctatatgcagaagttactgcaaacgtaaccgggatagaaatcaccaaagtaaccgctactgctatcacataactaagcatagacaggagcacctccttattaaattttcattgtgcgaatatctgttatagaatgtatgtacgccaaacattcttataagcgattttacaacacttcaattttaataaataacaggtattatgtcaagtagaaaagcatattctaaccaattttcataacatttgcacaagattccctgttattcccaggagttttccgctccgaaatcctcacagttcataactcttcttattttatccggtgaaaaacctttacggtacaggaaagcctgtatccgtcttttctcttttaagtctgcgctttccgcatcatagtgcttctttctgagcaaatctttaatcatggcctcttcatcctgaaggccatcctcttccttgacggtacgcatggcttcttcaataaggcttctgtccactcccttgcgtctcagttcatcttccatgcttctcctgcttttgcgctccatataggccgacacataatgcctggcatatgcagcatcatcaatatagccaaaggattccacataagcgagggcttcctcgataaccgacggcggatactttccctgacggagcttgtcttccatctgctgcctggtatattctctggatttcagcagattcatgcagcgcagctttgccctcttaggcagtactgtccccatgatttcctcatatatatcccgggaaatttccctgttctcagcaattccatatttatgaagttcgcctttgtataatacaaaggcgaattctccatcaatactgactgcatatttacttttattaactgcttctgtttttgtaataaccattctgtcttctctgcccatcaggctttatccggctcttttgcaggtgccttcacaggctcttttccttcttttgccgcctttgcatccgcggcttccctggcggctgccgcttttttatcggcagcttcctcttttttctttttgtccagctcatactgggcgcgtaccttctgctcgatttcatcacagacagcaggattatccttcaggaaggtctttgcattttcccttccctggccgatcttattcccttcataggcaaaccaggcgccgctcttattcacaatattcagattagtcgccaaatccaggatatcacccactctggaaattccctcaccgaacataatatcaaattccgcttccttgaacgggggggcaatcttattcttaaccaccttgacacgggtacggtttcccaccacttctccgccctgcttcagggattcaattcttcttacatccagccggatggtagaatagaacttcagtgcacggccgccggtagtggtttccggattgccgaacataattcccaccttttcacgcagctgattgataaaaataacagtacagttcgacttgcttattacagcagtgagctttctgagggcctgggacatcagtctggcctgaaggcccacatgactgtctcccatatccccgtcaatttcggccttgggcaccaacgccgccacggagtccactaccacaatgtcaatagcgccggaacgcaccatcgtctctgtgatctccagggcctgctctccgttgtcaggctgggaaatatagaggttgtctatatccacgccgatgttcttggcataaacaggatccagggcatgctcggcatcgataaatccggcaattccgcccctcttctgtacctcggcaatcatatgtaaagtgaccgtagtcttaccactggattccggtccgtatatttcaataactcttcccttgggaatccctccgagccccagggcgatatcaaggcttaaggatcctgtgggtatcgtctccacgttcatctgtgtggaaggatcccccagcttcatcacagcaccctttccgaactgtttctcaatctgtgataatgcggcgtccagcgcttttaacttttcatctttttccattgtcttctccttcttatccagaacagatgttctcttttcatatcataaaacatttgttcgtatttgtcaattcccaactttagaatcagtatataaaatccggtgtccgataaaactccctcataggcatccctcccttatttttataattgctttgaaattatgggcgaaacgcctgatatgcaaagcagatgttacagacaaggcctcccctgatacggagcagccttcagctaagatatgcttttatgattgtaccacagcggtgcggcaaatgccataggaaagtatgtttcttcggtaaaaatcccggaaaaacagaacggtcccggaaggcttctccggaaccgttctgtctgccgcccggccatcccgtgaagggatgcgccagacattaaatttttttcatataacgttcgtaatccttgattgtcacagtcacccacccgctgctggaactggttgtataattaaatccgatttccaggcctacgggcgtatagaaaataatattggtatcggaatccgacaggaaatcctggagctgttcatccgtcatctcatccaccgcctgcgccgtgccgttctggtaggcatcctggtcacgaaacgccttggcaagcttgggcgtatagtcgatcatatttccattatccatgagctcaccgctcaccagatctatgtttatactgtacagggagatgtaggattccatattcatggcaaaagattccctgagtacaatacttatcttttcctcatccatatatgttacatagccctggctggtggaagcataatacaaatcttcctcctgctgttccctgtaatacccataaagattgctgtaataggttgcctcatatttgatttcctcattcagctcatccatatgagggatatttccgcccttcagctgaggatatcttccctgggtggtcgccccggtttcatcatccacatagtcatattcttcccattccacgctgtaactgagatcatcccgcacggaattggcaagggtaacgtaataatcatcttcgggggtggggacgtaatcttcctcttccggttcggattcagatccgccgtaaccgccgttgttgttgttataaccgccgttatcctcgggcacgctctccggctccgaattttctgtgcttccgaagactcctttataattggcgagtccgccgccgctttcttttacggctccgcgcacaatcacatacacgagcacaagcacaatacaaagaagaatcgcaatggcggcaataatgacggccgcaagggttcttccgttattcctcttttggggcccgttgggataagcgccgtaaggactgccatagggaggtactcctccgggaggaacctgcccctgatatccgccctgccccgatccgtagccctggccgtactgaccgccataagctccgttctgagggcctcccggcatgctgccggcattgttctgcgccccatagggaggtacgttctgaccgtacggaacattctgcgggctgccgggagctccctgtgctccataagaggtattctggcctccgtaagtgttctgggaaccataaggcatattctgtccatagggtgtgttctgcgcgccatatggggtattctgtgccccatatggcgtgccctgtgagccgccggacgtattctgcgctccgtatgaagcgtttggggaaccataaggggcattctgcccgccgtaaggagcattctgagaaccatagggggcattctgcgtaccataagcgctctgtgcgccggaaactgtatccggcgtcccgttagcgggcttcggcacggcatcggaggtattctgagcatccggggagggctgctcatccggtgtattctgcccttcccatgaagacatatccggtgtatcctctgtttctgtccctgtgttcggtgtttctcccgaaagaaagccatcgctctctttatccgggtctgacggagtattctccgtatcggttgcttttttatttctgtcgtatccacagctgatgcaaacgccgtttttcattaatgctccgcattccggacagaaaccgtattcttcatcctcatacataatatttcctccatgctcaggcaacatttatgccagaagctttctttgcaaggccggaatcagacttttttaccaaaagtcttctgactgtagtattccaaaatacactgcctcatcattgttaaagcggcagacactgccgtttctcttatcttggcccggttcccgttaaaatggaattccttgacctgtgtggttccgcatacatagcatcccatgtaaaccagtcccaccggtttctcctggcttcctccgtcgggaccggcaatccccgttatggaaaaggtgacatccgcctttgtgagaagcgcggtgcctcttgccatttccttagccgtctgcgggctgacggctccgtatttatccagggtccccttcttcactccggcaattttcctttttgccttattggaataggtaatataaccggatttgaatacttcggaaacccccggtatgttgatcagcctggccgccagcatccctcccgtacaggattcaatcgtagaaaccgtgagttcattcgcaagaagcagatccacaaccgccccttccagggtaacatcttcctccgtggtgtaaacagcgcttccgaaacgggatttcagttcctttaccacaggcttcacttttttcctggcttccttttcgtcagcggcgcgggccgtaacacgcagatggacttccccggttttggcataaggggcaaccgtgggattttccatactttccaaatccgtgatttcactttccaccttgctctcacccattccgcagatttttactgttttggaataaatgataccaggctcctcagggttttccagtccgttaaggtagggaacgatactgttctcaaacatgggctttaattcattgggagggccgggaagcaggatgatccgcttttccccttccgtcaggatgatgccgggagccgtaccgttatcattatccaccacaatggctccttccggtactaaagcctgttttttattattttccgtcatttccagaccgcgttccttaaaaaaggattctatccgctccagggaatggccgtccattttcaattctctgttccatacccccgctgcggtctccttggtcaaatcgtcctgtgtaggcccaaggcctccggtgagaatcaggatatccgaccgttccaacgccgtgcgcatcactcccgccagcctttcccgattatctcccacaacggtctgataataacacgacaggcccaaccccgcacatttttctgccaggaacgccgcattggtattgactatgttccccagcaaaagctctgttccaactgaaattaattcaactaccataccgaacctcttttctttacttctgatcagccaggcaatccttgttcttaatcagatagtctgccagtgaaaccaccgtaagtatcagtgcagcccacatcacaatggaagttaccagggaaagcgccggaatatcggcgatcatcagcacaatcatcaccatctggaaggtggttttgaatttgccccagtaaccggctgcaattacaacccctttatccgatgcaacaagccggaaaccgcttataataaactccctgctcacaataataattacaatccatgcggggatctttcccatttcaaccagacagatcagcgccgcacagacaagcagcttatccgccaggggatccataaatttcccgaaggtcgtaaccagattatatttcctggcgatcttgccatccagcagatcggtcaggctggctattacgaacaaagccagggcaatccatttcgccacgccggcgcctcctatagggaccagcataaaaaccacaaagggtataatcattatcattcttacaattgtcagcttattcggtaaattcatcttccagctctcctatcaaatcatattcataagatccggtaatacgcacattcacaaaatcaccggtcatcaggtcctttgaagtattgataaacaaaaggccatccacattcggcgcatccttataggttctcgccacataggcattctccccgtccaccttgccctcaaccatggcaggaagacacctgcccttcatgttctccgccttttcaaaagcgatttcctgctgaagctccatcagttccgcctggcgctcttcctttatctcctggggcacctggttttccatctgcgcggcagccgttccttcttcctgggaataggtgaatacacctaacctgtcaaattccagttcatccacgaaattatacaattcctcatgatcctcctggcattctccggggaacccgctgataagagtggtgcgaagacagatatccgggatttcctcccgcagccttccgatgcgctcacgcagctcggcctggttggtgcgtcttcccatctgccgcagaatccgatccgacgcatgctggatgggcatatccaggtaatggcagattttcggttctgttttaatggtttcaatcaaatcatccgtaatttcttccggataacagtacagaagccggatccactcaatcccgggtatcctgcaaagctcgcgcagcagccggggcagtgacttttcaccataaaggtcttttccgtaaaccgtggtttcctgagcaaccagaatcagctctttcacgccgccttccgccagttctgaggcttccttaaccagaacgtccatgggaacgctccggaagcttccccgtaccttgggaatgatgcagtaggtacagcgcttgtcacagccctcagcgattttcaggtaagcgaaatggccgcctgtggtcacactgcggtgtttcccgtaaaccagcgccgcatccggatccgtaatgtggttatgccgttttcctccgcacacctcttcaatggccgccacaacgctgtcaatcgccatggttcccaggatttcatccacctcagggatttctgtctgtatttcttctttataacgctgtgcaagacagccggctacaatcagcgccttcagctgtccgctttttttcaattccgccatctccaggatggtattaatgctttcttccttggcgtctccaataaaacagcaggtatttaccaccgccgcctcggcttccgattcatcatccgtaaaagtatgcccgctttcagccagcattcccagcatcatctcggtgtccacaagattcttatcgcagcccagggaaataaataaaatcttcatatttttttacgaaaaaagagaaacgcacacggcaatttctcttctcccttcccccatttcactcttctgtttcttcatccccgagaatcttaatcttgccttcattcagttcttccaccgcaacagataaaggcttcatgcctgttttcatatttaccagcggctcatcgcctccgatgatctgccttgctctcttagaagtggccataacgatggaataacggctgtttacaatattggtttcaccgggctccacatcgctattcactactttcattaaatcggtataagagggatgtaacatgtttcattctcctttcactaatgcgtccagttcggaacgcatgccagctatcaattctttatttcgctgcgggctcctgcgtgcggcatttatgatgctgtgcatctccttcacgcattcatccaatttatcattgattatgatatactcataattttcaatgccttccgcttcttctgccgcacggctgatgcgctgacagatgacttcgtcactttcggtacccctgccctcaagccttctgcgcagttccttcgcgctgggaggcatgataaaaagaagaagggcatccggaaatttttctttcaccttaagggccccctggatttcaatttccagaatgacatcctgtcccttgtccagacaggactccacatattccctgggcgttccataataattgccgcagtagcaggcatactcaatcaaaccatcctctgcaatcgtctgttcaaaggcttccttttccacaaaaaaataggacttaccttcttcttctcccgccctgggctttcttgttgtcattgataccgacagcgcataattatcataggtgcttatcagttccttcatcaaagttcctttgcccgccccggaaaaaccggatacgacaatcaggattcccctatgcttcatcattatcctcccgttcggcctgtgcacggtttgcaatggtttccggcaaaagtgcggaaagcaccagctgtccgttttccatcaccagcactgcctttgtctttcgtccctgtgttgcgtccacggccgtccccgcctctctggcagtctgcaccattctcttaatgggtgcggaatccgggctgaccaccgcgataattttagcggtatttacaatattgccaaatccaacatggataaactgactcatattcgctcccatttgctgttattcaatattctggatttgctccctgactttttcaatatcggttttcagctctatagccctgttggaggtctccagatcgttggccttggaaagaatcgtattggcctccctgttcatttcctgggcaatgaaatccagcttcctgccgatgcttccccctgttttcagggcttccctagtggtttcaatatggctccgcaaacggaccagttcttcatccacgcatactttatcggcaaagatggtcacctccataagcaggcggttctcatccacctgggtatcctccagaagctccttaaccttatcacgcagtgtctgtctgtattcggcaataatctgaggtgatctttcctcaatgaatgccacactttccagcatgccgtccagcttgcatatcagatcctctttcaggttatccccttcggcaagtcttgtctgtacgagtccttcggcggctccgcggagcgctttttccaggctcttccagatcccttcctcatcaatggtctgctcctccatggagaaaacctcagggaacctggataatgaggaaacacgtatatcattgtccagagaaaattctgcggccatctgtttcagatattccatatattcagcggcaatatctttgttgtacttaattgttacattattttccgtaaagtcttcataagaaataaatacatctactttaccgcgctggatatattccttcagaaggcttcgtatcgacgcctcaaaaaaattcagcttcttgggcatcttaatactcacatccaggtacctgtggtttacagatttcatttccacagtgaatttacgctcggcctcgctgatctcacatctgccgaagccagtcatgctttttatcatcagtattcctccagaagatacattcccataattcattttattataaatcaccttccgaaagtagtcaaggatttcattttttgccgtttaccgcccgttttcttaacaaaaacagcttcggaagcagtaaaaacggcgccatcgccaaactttacaaaatctctgccataattgacaattccccatctatatacttcccggggaaaaagttatactgacagcatcataataaatcaacattatcaataaagaaagaaaggtacataacaatgaatacgaaaaacatcacagtcaccgacaaccctctcttaaatacgaacctggataccaattttttaaagctggtggctatcatcagtatgttcatcgaccatgtgggagctgccttctttccggaataccctgttttccgctggctcggccgtctggctttccccatcttctgttactgcatgaccgtaggaatgctctataccagtaatatccgcagatatctgggacgccttggcctgtttgccgtcatttcccagcccttctggatactggcattcaaccctcaggatatcctgggcaacctgaccaactggaatatcttctttacattatttataagccttctggccgtatggggttttaaagagaaaaaatggtggcttttcatccttgccttcctggttatatctctgtggaattttgattattccagcacaggcatccttctcatgctggttttctatctctgcaggaaaaaaccttctctcggcgccgtcctgtatgtactgctctatcttccggccttttttacggcatcgccgggagatcctctgagtctgactatcggaaattacggcatcggctttgaagcaggagccctccttgcccttcccctgatcttcctgcataccaatacttccctgcgtatccccaaatggttcttttacgctttctacccggcccacctggccctgatcgccctggtacgttttcttcttggtttctgagaacccctgcaatattagcttttccaacaagggctcagatgttatctgcggacagcatctgagcccttgttctcttttccttcttctgctatacttaatatcatgatatttattttaccgcacagataagcacagccggcgtttcatcctattcggctgtgttttcccgcagaaaggacttcctatggcatttgacggcataaccattgcaaatatacgaaaagaactggatgacaccctgaccggaggacggatattcaaaattgcgcagccggaaccggatgagctgctgctcaccataaaaaataacggagcgcagcacaggctcaccctttccgcttccgcatccctccccctcatttatcttacggggaaaaataagaccagtccgatgactgcccccaatttctgtatgctgctccgcaagcacatccaaaacggcaagatcatcagcatcacccagcccggcatggagcgtattctcaattttgagatcgagcatcttgacgagatgggcgacttatgcagaaagctgctcattgtggagctgatgggcaaacacagcaacattatcttcagcagcacctcaggcgtgatcatcgacagcatcaagcatatttccggtctggtgagctcggtgcgcgaggtgctccccggcaaggaatactttattccccatacccaggacaaggaaaacccgctttccgttaccagagagcaatttatggaacgggtatttgcagggaatatgccttgtttcaaggctctttacaccagcttcacgggtctgtctcctgctattgcccatgagatctgctatcgggcaggaggtaatgcggatctctccaacgccgccctggatgaggacggacgggaacggctttaccgctcttttcaggagatgatggaggatgtacgcaccggcagcttctccccctgcattgtatatgaaaataacgcacctgcagaatatgcggcggtatgtctcacttcttatccggaaaatgcaagaaaggattacacatccatttccctgcttctggaggactattatgcggaaaagaacaccattacgcgcatccgccagcgttcctcggatctgcgccgtattgtttccaccgctctggagcggaacgtaaagaaatatgatctgcagttgaaacagatgaaggatacggaaaaaagggataagtaccgggtttacggagaattattgaacacctatggttatgatgtgacgcccggttcccgctctatgacggcactgaattattatacgaacgaagaaattgcgatacctttggatcccactctcacaccgggagaaaatgccaaaaaatattttgacaaatataataagctgaagcggacctatgaggctttatcccagctcaccctggaaacaaaagcggaaatcgagcatctggaatccatcagcaactctctggatatcgcattgaaggaagaggatctggtgcagatcaaggaagagctgatagaaagcggttatatccgcagaaaaggtggctcgaaaaaagtaaaaattacaagccggccgttccactatctcagcagcgacggctacgacatttatgtaggcaagaataattttcagaatgatgagctcacctttaaatttgctgtcggaaatgactggtggttccatgcgaaggggattccgggttcccacgtggtggtaaaatcccgcggagatgagctgcctgacagtactttcgaggatgcggcgcggctggccgcccactattccaagggacgcggccaggaaaaggtggaaattgattatacggagaagaaaaatgtgaaaaagcccggcggcggaaaacccggctttgtcgtatattataccaattattccatgatgatcgactccgatatcactgcattagagcaaatagaataaaaggaaggtttttttgatggatcaaatttgcagggccttacaaccggatgaaatcacttctgtctatgaagtctgggggagttcccatttcccggaggatgaactaaaaccgctctcttcaataaaggtattgttagagcaaaaacagtattccggctatggtttgttctcgcaggaaagcgaaactgaagatgaggaaggggaatcgcttctcgggtatgcctttcttctgcatgacaaagacaaaaagagaatgcttcttgattattatgcctttctggaggagcacaggaataaaggatacggcagtatttttctgcagaatatgaggggcatggaggatttccccggctgctatctggaatgtgaggatccggatacggccgattccccggaggaatatacactgcgtaaaagaagaattggtttctaccagagaaacggcgcttatctctcccgggtacgggcccgtttgtttggcgtgacctatcgtatgctctggctgcctcctgcaagcggttttgcatgtacggcaggcagaacttccggcctttatacggatatggatgaatccctggaagcacaggaattctttttacaggatcttaccgacttctacctgtccgtttttcctcatccggtatttaaacaaaatatgaagatctggctcgcggaagcctgataccaaaaaagtcactgtatggcagagtgccgtacaatgacttttttagtaaatctaaggacagcctgcaaatcaaggcatccgttgtttatcctgcgtttaaacttaaagtgttccggaagtaaacaatccctttacatggtcaatctcttcctgtgtagccttctgggccggcacataataagatttatcccttgcaatctggtaaagctgctcctgggactgctcgcaggctgcacgtatctgcttcagagcacttttcagctctttgttttctgtctgggggatcatttccccgaatcttaccagttctccgttaatacttgccagagtatctgataccattgttttttcctgcatcatggttattctcctccttactgcaaaaatttcatcaactgctgcttgttttccattgcggattttgcgccctgctcaaaaaactgctttaccttagcgtcttctgcacaggaagcatattccttcaatttgcagtgagaagtgtcataaccgccaataagatggcgcaggttctgaagatcgagttccgataaatttgccatgtccatacctccattcatttacatctgccttagtattatgcgcattcctgaatggaaatataccggcaggtttttacattcccaactcctcataagggatggtcacttctgtataacctgcggcgtaaggagcgatttcataaggcgtggtataaaatacgacaccctcatctgttaaataataatattcgataaaatcattttttgcattcagtgtttcggcggcatcttcaaaaaagccgccttctgtatcattctcaaccacttccaggaatttatcccgtaccatcgtatttaattcatcgttggaaagattgatgaggctggctaatgtcacctctttccctgtttccttatcaaaaatatgattatttcttcccggcataccatgcgcgccgccttcataggtataggattcatggtatacagaaatcaaattgccatgagaaacgactcctcccactgtgaaatcttcctcgctcggaggcatggtaaaggcttctgtctctccctcagccgcagtctgggaattttcttcctccgtacggtactgcatggcatagcttacgatagaatccggatcattttcatagttttccatcatgtcggaaacccattcttcataaaattcatttatttttttctcgccgtcagagtccccttcaaaaacaggatactccagctttacggtgcatgccagctgtcccttttccgtagaccaggttttctcctccttttccagatggtatgtgtattcgccggcctgcaggcctcccttttcaccggaggtctgcgtctcttctgtcgctgcctccgtggtttcctgactggtttctgcggaagctggtgtctcctggaccgtactgctttctgtctgtgcaacagttcctgtgttcccgtctgctgactttccattacagcccgtaagcagtaaagcggctgtcaatgtcaggcacataaattttttcataatatttctttcctctctttgttttttatttaattttatccttcccaatgagaagggttttaaacgtataaaaaccatccggtgccggttttccgaccgtcccggatggttccccccttatttccccataaataatttatttctgcatttacaacaaatcagccgataagccagtcatacatttcctggtattttcttgcagatacctgccatgaaaaatcagctgccattcctctgtcaattatcttattccattctcttttcttatcataaaagatcttttccgcataccggacagctcccagcatttcatgcgcattataattcataaagctgaaaccggtgcctgtgctttcaaactcgttatacggttctaccgtatccttaagcccgcctgtctccctcacaataggaactgttccatagcggagcgcgattaactggctgagcccgcagggttcaaaaagggaaggcatcagaaaggcgtcacaggaagcatatactctgtgtgatacagcttctgaataatagatctgggcggatacctttccgggatatttccaggcaaaatggcggaacatgttttcatactgctcttcaccggtacccagcaccatgagctggatattatcctgacacaattcatccataacataggcaaccaggtcaaagcccttctgatcggtcagacgggatacgacaccgatgaccaatgccttatcatcctgattcaatccgaaatcagcctgaagcgcacgcttgttttttattttttctttacggaaattaaccgagttaaacggatgagtgatgtatttatccgtttccggattatattcatcataatcaatgccgtttacaattcctctcaaatcaccgctccgcgcacgaagcaggccgtccagcgcctctccgtagaaaggggtctttatctcatccgcataggtttcgctcacagtcgttaccgcatccgcatatacaatgccgccctttaacaggttggcatccttataggcctccagcttatccggagtgaagaaagacatgggaagcccggtgatatcctgtacctccttgatgctccatttcccctggaatttcaggttatggatagtcatggccgttttaatgcccctgtagaaatcgctgccctggaagcgttcatgcagataaacgggaaccaggccggtctgccagtcgtggcagtggattaggtcaggccggaaatcaattaccggaagaatggacaaagccgctttggaaaaaaatgcaaatttctcaatttcaaataaggtgttatcgctgtaaggcttgaaaccgttaaaataatattcattgtctatgaaataatatgttacatcatcgtattcagcctctaaaatccccacatattgattctgccaatggaagtccatgtaaaaatgggttttgtaattcagtctgtccttcatttcctgggacatacatacatatttgggcaagataacacgcacgtcataatatttcttatcgatacatttgggcagcgagcctactacatccgccaaaccgcctgtttttatgaacggtacgccttctgaggccacaaataaaattttcttcatactgaatcctcccgtaatttcttaataccttccccggtggggttacagttattatacatcattacggcgtttattaaaaggtcaaattttatattgaagtcttattttgtccgcaatcagggcaataaattcggaattcgtcggctttccttttcctgtatttatagtatacccaaagagagaatccagtgtttccatctttcccctgctccacgcaacctcaatagcatgtctgatcgcacgctccacacggctgggcgtagtctggtatttctttgcaattgtgggatacaggattttggtgatagaattgagcatttcaatgtcttccactgacatcatgatggcttcgcgcaggtattggtagcctttgatatgtgcgggaacgccaatctcatgaatcatatccgtcacgtctttttccaggttgtgtgcggcggcaggctttacagccgtttcttcttccttcgccatttcagacagggatgaggcgccggatgccggcacggtaatcattatctggaattctttattcgttttcatcagatccgtgaggatctgtaccactctttcgttgtctttgcctgcgctcatgcgtaactgttccatatatatcctccattccaacagaaatctttttctttctgtctcttcctgcattaattatataagaatgacaatttatggcaaccttctttcgtcgcaaaaaaggcggtgtatcgtgttttttcggaaataatcgcgctttggaagagcgaaatgtggcgaatcatggggaaagatggcgacagttagcagggaactgcagaaaacacatgggattgagataaatcagagggtaaaaaaaaccgacagaatcatcggcagaagccgcagcagccaggaaatgctgtattttcctggctgtggtgctttgcttattgcaggagcatattttcgataaagattccgaatcctctggtaggatcctggaccaagacatgggtgactgccccgataattttaccgtcctgcaaaataggactgccgctcattccctgcacgattcctccggttgtttcgagcagttcacgatccgtgacctgcaattcgattccccggttgatattgtcatgatccaggtgaatggctgtaattttgatatcataaagctttggttctccgcctacgctgcacagaatctgggcgggtcccgtttcaacctcctgcttaaggccgatgggcatagcctgtgaggtgatgtgggccgcagcggaatcattcagttctccgaaaattccttctacggtattggcctcaattgttcccatcttattgctttctttgtagtctatgacgcctgtgagttcaccgggcgttccattctctcctttggttatggacacaatttcggtctggtaaaggcttccgtttctaagattcatcagtgtggcggtatccatatcattaattccatggcccagcgcgccgaaggaattgttttcgtctatataggtgagggtgcctactccctgtgcattatcccggatccatataccaagcttatactgtccgtcctggttttcctccggttttactttcagatcaaattcctgatcttcccggagaatggtgagcaccatctcttctccgttgctttcctcgatctgcctcataaaggcaacttttccttccacttccttaccgtccgctttcaggatataatcgccttccttcagcagatgtcccacaggttccttcagctgaccgtcaacaccggtaaaatcccctgtggcaatcaccagtatcccttcggtcttcacatatattccaatggggacacccgccggaatcagtgttttgtcattgataacctgcacattaacggatttgaatggtatcaggccgaaaagcttcaaatccatggtgtacgtatcgatatcttccgcatataaggtaagtgaatccgccagatcgacggaaaggcttttgggttcctttttttctgccacagaactcatacctgttaccggtattgcttcatccccgtctgcagtgtctgagggcgccttatataatttgccggaaacaggtacgttcagatccaaatcctgcctgaccccggcccgaatatggatggcccggggtattttttcccaaataaggaaaagccagcatatgattaacgctgtcatagagcaaatcagcaaaacatataaaaataagcggtacttttttcttttttccaaaatttcacatccttcctgctgcttattctgctgatagcaggcgcagctgcttcgggtcttttggaccctttcagcaaagaaaaggacatacattcaacatgtacgtcctttctagtatgtgacaaatggttaaagataatttagtattgttttgtatttgctgccatttctttcaattctctcgcgttcgccagcgcgttttccgttatcgtatcgctcccgagcatccttgcaagctcgtttaaaatatctgttcccccgatttccataatagccgtgctggtggaatcttccatggattttttttctataataaaatgattatccgccatggcagctatctgcggcaggtgggtaatacagattacctgacggctctttcccagtacggcaagcttcctggacaccttccatgctgtcttgccgcttattccggtatcaatttcatcaaaaataaaggtatccttatcctcctgccccgcggtgattgttttcagggcaagcatgatacgggaaagctcaccgccgctggcgacattggccagaggccttctgggttctccgggattggttgaaatcatgaaggaaacctcatcccagccgtcggggcctatagaatcctttcgttccacttccaccgcgaagtccacctgattgaaattcaaatcctgaagagcttctataaaaagctttgcaagcttctttcctgcttttttccgtatttccgtcgcacgggtacatacaagctcaagcgcgccgcgggcatcccgcagctgtgcattcagcttatcccggtaagcatccgcatctatcagccgctgcagttcttcctctctgttttccttatataataggatctcttcgattgtggatccatatttatccttcagccggttgatggtattcagccgttcctcaacctgcagaaaatcgttttgatcaaattccaaatcggaaaggtaatcggataccgaacggttaaagtcattcagcaaaccatctatatccatgagcattaccgccatttcatcgagaacgctgtcatatgcactcacgctgttcagctcccgcagcgccctgcccacggcttcaccggcgcttccttcctgatcataaccggtaaggatatggacattgccgagattttccgctattttgcggctgttgctcattttctgatattgcttttccagttcctcatcttctccggcctttaaggatgcgttttcaatttcttccacttcaaaacgggccagtgaaagctgtctctccttttcccgctcatccagatcggtttcagccagtttttcctgaatttttctataaaattgatatttctcttttatctctctttttatacgggaaaattcttccccggcaaaatcatccagaatttccaaatgtttttttgtctgtaaaagctgctgggaatcgtgctgtccgtgaatatctatcaaaacaccggagagttcctttaacaaccttgcgtttaccgtctctccgtttaccttgctgatactgcgctgaggcataatcctgcgctgaagaatcaccagaccgtcttcctctatgggaatatccagtttcttcaccttttctatctgcccttctttttccagctggaataccagttcaatcagtgcgtagtcagcgccggtccggattaaatcccgatcgccgcggcctcccagggccagacccacggaaccgatgataatcgattttcccgctccggtttcacctgtcaggatgttcagatgggggccgaaaaagacctcggtctcctgaatcaatgccagatttttcacatgtaagctcactaacatttttcttctcctatttgccttccgaacgttgccctgcctatcccctttccggctcctaatttttcagaatttcccggattttatccatcacgattctggtgtcctccacactccgcaccgccatcataatggtatcgtccccggcaatactccccacaatttctttgaatttcatggcatccacggcagcggctaccgccatggccatgccggagacagtcttgagaaccaggatattctgcgccatatccatggacacgaaaccgtccttaagcaccctcacgtacttatcccacaggctgctgtcatcctgtctcagaacaatgtatttctgcctgccgttcccggccgggaccttggacagatgaagctgcctgatatcccgggataccgttgcctgcgtcacattgaagcccgcctcccgcagcttgtccgccagttcttcctgggtttctatttcatagatgtcaatcaattccacaattttttcatgtctgttttgtttcatcggtttactcgctcatctttctatgtaaacgctccaggaagcttaattcgctcagcctcataatagaggtggtcttgctgctgcgtgtcaccttgattctgtctcctgtcttcaggaggaggcagctgctgccgtcaaagtttacttccacttcctgatcctgtcctgactgcttttcccctatttccaccaccacttcatcctccgcccggagaacaatgcttcttatattcagcgtatgggggcaaatgggggtaagaacgataaggctcgcccccggctccacaataggccctcccgccgacatgttatagccggtggatcccgtcggtgtggcgatgacaataccatccgccccataactgttcagcacctggccgttcacccagatccggaactgtatgacctgcagaggccccttccgggttatcgccacatcattcagtgcatgaacctgcgccgcttccccactgccgtcttctctcagcacccgtccggaaagcatcatcctgtcctctatggtatattcttcccgcaaaagcttttccaatgccagatccagcgctatcggctccacctcagccagatatcccacagttcccaagtttaccccgagaaggggaattccgtttcctgcggtttccctggcagccttcagcatggtgccgtctcctcccaatactatcatacagtcggaacgcagatcaccaccgccttctttcaggcggatctgctcctccgattcattatctgcacagactgtacaggtggccccccggtcctccagatatttacgtatgtaagaagtaaccttcagccccggatcctttggcctgtttgtcataataatataatgtttgctgcaccctatacccatgtctatgttacccctgtttcgcttccttttccagtgctccgtgcgcctgttccacaatttcaccaacggttttcttccaggcctcatcctctgaaagcccgcttttttccgcctgtatctccgatagctttcgctccgcttcatgctccgtaagagaaagcacttcttcaggcaggttatcctttttctccagatagaccagatactcaatatttccttccggccctttcacaggagagtacgttaatccttctatactgaagccggtaagggaggcaaaatccaggactttggctatcacctcccggtgcaccgcaggctccctcaccacgcctttcttaccgaccttatctcttcccgcctcaaactgcggtttgataaggcataccatacggccgccttccttcagaaggtttctggcaggtattaatattttggtaagagaaataaaagacacatccacagaagcaaaatccagcctgtcctgaatatccccggggaccatgtaacggaaattggttttttccatgcacaccacccgttcatcgttgcgaagcttccaggccagctgtccgtgtcccacatccacagaatatacttttgcggcaccgttttgcagcatacagtctgtaaaacctcccgtggacgcaccgatatccatgcataccgttcccgcaaggctgatgggaaagcactgcatggccttttccagcttcagccctccgcggctcacatatttaagcgggttttccttcaccgtcagcacacacttgtcttcctcaaaaacagagcccgccttatcctctcgctctccgtccacaaaaacgtttccggacatgataattgctttcgccttctccctggagggcgcatacccctgttttaccagaagcacatctaatcgttccttcatcagacttcccctaatacttcatgaatacgtttcagaatggaatcactgtcaatcccgatttcctgtttcagcagatccacatttccatgctccacatactcatccggtacagcaatggaaagaatccggacaggcaggccgttatcgtccgcaaaggtacgcacccgttctccgaaccctccgctttccacgttttcttccatggtgaccagaagcttatgggtatggaccagcttccggatcatgccttcatcaacaggcttcacgaatctggcattgacaagagtacagaacctgccctccagcttcagctgggcatatactttttctgctgtttttaccatactgcccacggcaagaactgcgatatccttttcctcatagatcatttcgcttcgaccgtattcgattggagcgcggaaagccgccaggccgtcataggcctcgcccctgggatagcgcagggctatcggcgcgccgaagccaacggcaaacttcatcatatcggaaagctcccatttatttttaggagccattatatgcatattaggaatggaggacaggtaagacaaatcaaatataccctggtgcgtctctccgtcgctgccaaccagccctgccctgtctattgcgaaaatcaccggcaggttctggatacatacatcatgcagcacctgatcataggctctctgaaggaaggaggaatataccgcaaccacaggcttcagtcctcctgccgcaagcccagctgcgaaggtcaccgcatgctgctcggcaatccccacatcaaagaaacggccgggataggcatggctgaaacgcttcaggccggttccgtcaggcatggcggcggttatcgccacaattttttcatccctctgccccagcttcatcatcaccgtagaaaagatatccgtataattggccttcatttttttcttcagaggcactccggtctgcacatcaaagggatccgctccatggaaacgggcaggatggttttccgccggcgcatagcctttgccctttttggtcagcacatggatcataaccgcatttttcctgcgttttgcctcatttatcacccgtataagggaagtggtgtcatgtccgtccaccggtccgagataggtaattcccatatcttcaaaaagcatgcccggtattaccagctgtttcaggctgtttttggcacgccgtattcccgccaccacaggctccccgtatctggtattgcggatagcgtcatagattccgtccttcacatccagatatgcatgggaggtacggatattgttcagatatttggatacgccgcccacattttcggatatggacatattgttatcattgaggataataataaaattggtttccagcctggcggcattattcagggcttcgtaggccatccctcccgtgagggaaccgtccccgattacggaaacaaccgtgtagttctccccctggagatctctcgcctttaccatacccagtccggcggatatggatgtagagctgtggccggtgtcaaagctgtcacagtcgctttcctttcttttggggaagccgctcattcctccgtatttgcgcagattttcaaatccttctttcctgccggtgagcagcttatgggtataggactgatgtcccacatcccatattattttatcatccggcagattcaatgacagatgaagagccatggtaagctccacagccccgagattggatcccagatgccctcccgtaacacttattttacggacgaggaagtccctgatttccgatgccagcgcaggataatccttgggatttatatttttaatatcattcgctttttgtatctgatcgagaagcataatatgcctccttttatttttttctggtaattaaatcatccaccagtatttccaaaaactcattgcggccggccccgcccttctcacaggcgattgacgaaaggcctgatatagcctcctctgaaagacggcgcacctccttaacggaatgctccatcccattgagagatacatatgttaccttatggttcttaagatcactgccggtctgtttgcccaatacctccaggctgcttgtaatatccaggatatcatcctgaatctgaaaggccaggccgatacaggtgccgattttctccagacgttgaagctgttcatccgacgcgcctgccagcaccgccccgatcatcatggagctctggatcaacgccgccgttttattttcatggatatagagcagaagctcctgagtcactttttcctccggcagctcctccgcctccgtatccgcagtctgtccgcctatcattccgtatattccggctttctgtgccagaatggtcatggctttcgcacagcggggaagcactccgagttcttcttccgccatggcaaaggatctgcatgctgtctcaaatgcataatttaaaagggcatctcctgccagcacagccattccttccccgtatacggcgtgagtcgttttacgtcccctccggtattcgtcattgtccatacagggcagatcatcatggaccagggaatacgtgtgtatcatttccatggccgccatgaaaggctccacaagatgtccttcgccgccgaacatacggaaggtttcctgcatcagcatggggcgcagacgctttccgccggccaggacactgtaattcatggcctccagcactgtcttctggtaccccacttccgccggaaggtatttcttcagaattttttcaatttcctctaccttttcctgccgtacttcttcaaaattcatccaaaccgccctcctcgttcagcatcagtacctttttttccactttatctattttatcattacagattttcaataaatccattccctttttatacgcctgaaaggaatcctccaatgtaatttcctcatcctccagtgtacgggtgatatcatcaagcaggctgaaagcctcttccagggaaggcccctggtcattcttttccgcttccacagtttccggttcctgcactttttcctttttcatatcttaatcttctcctttctcttttttccacaattccttatccgtaaccagcgtttcgattttaccatttttcacatgtatggaaagcctgtctccgaccgccacacgtttcacatcggacaccgtctttccctcactgtcggaaacataggaaaatccctggttcagcttgtccagcggagaaaggccctttaatttttccgtatacagccccagcatatggcgtttttccataagcctctgcttcatcagggccgagagctgttcctccatacgaagggcatacatccttttttcccggatctggttggccgggcttaaatactgcagtttggtgcgtacctgcctgattttggaacgttcccattctatccggttccttattctcgcattcaaatcgtttctgcagccttccagcaacgcttccagctggcgtatatcataaacagccagttctgcagcggcagacggggtaggcgcgcgaagatcggaaacaaaatcgataatcgtagtgtccgtttcatgtcctacagcggatataataggaaccgtacaatcaaaaaccgcctgagccaccgcttcttcgttaaatgcccataaatcctcgatggatccgccgccgcgccccactatcatcacgtccactccgatatgctccagagcccggattccgcgtatgatactggccgccgcctgctctccctgtacaatagccgggtataatataatctgtacgtaaggattcctgcgccgcgtgatatttataatatcctgcacagctgccccggtaggtgcggttaccacccccagggttctgatgtatttgggcagcggctgtttatactccgaagcaaaaaggccctgctccagaagttcccgtttcagccgttcaaatttttcatataaataaccagctccgtccagtatgatctcccgggcataaagctggtactttccgtcccgttcatagacttcgacgcttccgcccaccactacctgctggccttcctccatgcggaacttaagtcccgcccggtttcccgcaaacatcacacaggcaatggtgcccttcgcatcttttattgtaaaataaatatgcccggaagaatggtacttgcagttgctcacttcccccttgacatatatattctgcagcatgaaatcctgagaaaacatattcttgatataggaattcacctgcgctaccgtatatacatttttcacttggtttcctctatacaaaccgggcaagcacgccgtttacaaagcccgcggactcatcctgcccgaactttttggccagctccacagcttcattgatcgccacgctttccggcacttcttcatcaaatttgatctcatatacagccaggcggataatggtcaaatccaccttgcccattctggaggttgtccagccctttgccgtggtattaatcattccgtcgatctccggcagcttatcctgaatcttttcaaatttgccctgaatataggcggcatctttttctcctatgccattttcctcatcctcaaaaaaaagctggcactgctcaggcatttcttccttcggattaaattccacacggaacagcagcttgaaaatctgttccctttgttctcttctgcccattatttcctcaattccgccggtatccggcatcttagtatcttccccccgcggcttagcagcatccggaaagaaaaggaaatgaaacctttccctccgtcgggcgcaccgcaatataccgtaagtgcctttcggaatacgaaaggcacctgtcgtcaaacctgaattttagtttcccggataactgttcagtaccttcacagttattgcaaaaatccatcctaaatcgccttcggcgacaggatttttgcacccctgaatcactttcttacggtcagcgcagtaaatgcgcagacctgttgaacagttagtttcccggctccatatttacattaacaatacggatatttacatccgtcactgtgagccccgtcatattttcgatggcatttttaaccttttcctgaaccttgctgcatgtttccggaatattatagccgtattccaggcacagagcgagatccgctttcacggtatttcctgccacctgcacttttacacccttgctcaggctctttactccaaccttgccgataagctcattggtaatattgcctgccatggcagacacgccttccacctctgtagccgcgagggatgctatcatagccaccacttcgtccgcaatctgtacggaaccgatgctctcgtctccctgcagaacataggtatttctattatcgtctttccttgtatctttttccataaggctgcctcctttattcctataacactgattataacaaaatcccgcacctttgcaaagcctttttatcatagcggtgcgtgcgtcccccatcgcatcccttggatttcctgcctgcctatgctgtccgcctgccatatccgcccggttccccggtgcaggcccgccgctctgcaaggttcctgtgcgggcacgctttcgctcggataactacgcagcggtactaaggctgcaaaatacgcagcctaaggaccggcgtatttatacggcccttactggaatccttgcagagcggcgggcctgcaccggggaaccgggcggatatggcaggcggacagcataggcaggcaggaaatccaagggatgcgatggggaactaatataagtaggtactaataataagtaagtacttaatataagtagatacttatataagcgggctctaacataagcggcattaatataagggatattgatgtaaggggagttactccagccagaagcttagggtgaactgctcttgggtgtctacgtatgcggctgaagcgttgtcgcctcttaggtagtcaaaaattttctggtcgtcgaggagtgtgtttttcatatcctggtaaacggtctggtctgcgcacttcagggtgacgatgcctttatcttcttcgtagcctctggcgaacagatttgagagtttggtttcatccacgctttcgaagtatgcattttcacggacgtaatagttgtctgtcatggacgtgcattccggaagggggaaggcgttgtcgattttatgtgtctggaggagctgctgtgtagtgacgagaaggtaatcgtaatttacactggggcgggtttttccctgccaggcggggtcgtcgtcgcccatgaggtaataggcgtctccccatgtgggatcgacgtagtaccattctccgtcggccagtaccatatcccatgcgtggggttctccgttcttcacacggccggttacaagaactgccggaattcccagacggccgcagaggaattgaaatgctttagcatacccctggcatacggactccccatagaggaaaacggaacatattgtctgattttccggcgcgtccagtctgtagtccgtatgttctatcatataatcataaatatatttgattttctgataatcgtccataccggtatgtatgcctgcaagtgcctggcgggaatagcgttctatgccttcctcacgttccctcacctgttcctgtgtcagggtatattgtccggaaaaggtgattttatggatttcctctcccagtgtatgtttggtataggtatagccgtccacataaaaaatttcgggatggtccgccatgatactgttaaaaaccggttccagcaaatcgggattcagggttgacagctcagcagcccgtccaaagccggttattgcctgcagcatctcccggtaaagctgctgttcttcttccgccagcagcccatacgcatagccggtttcctgtgaaacagaaggggtgccttgcccctcctgttctgtaccggactcctcctgcaaagctgccgggacggtttcctctgtcggggattccgtgctgtttacggattcttctgaagccgtaaggctttcggtttcttccgcagtttctttttgaggcagaaagcggggcaggccgcctggtaataattcacccttccatgcccataaagccgtgataaaaatcaaaataacaagaatgactactacggttttggaaaatctcttcattctgcatgactcctgtccattgtggccgttccggctgttgtctcgtttctgttccgctttccctctgcaagcgttttatcccggatttaattccggccgaattcagtcaagataagtcctttatttctgtcaatggtcattcccacgctccattcattcacgaacagaagaagcggatttcctttcatatcctttaccttcttcatatcagaggttcccgtcagcttgtccaagtcaaactcatctttattttctatccagcggatatattcataaggaaggggctccagacggatttccacgttgtattcattattgaggcggtatttgagcacatcaaactgcaggacgcctaccactcccactatgatctcttccataccggtattgtattcctggaagatctggatggctccttcctgggcaatctgggttattccctttacaaactgcttacgtttcatggtatccacctgacgcacccttgcaaaatgttccggggcgaaggtagggattccttcgtaggcaaactcttccttgggcatgcagagcgtatcaccgatggaaaaaacaccgggatcgaacactccgataatatcccccgcataggcttcatccagtattttccgctcgctggccatgatctgctgcggctgggaaaggcgcatgatttttcctccctgcacatgcttgacctccatgctcgcttcgaacttcccggagcagatacgcatgaaagcaattctgtccctgtgggccttattcatattcgcctgaatcttaaatacaaaggcggaaaaattattttctaccggttccacaacaccgacatccgattttctgggaagaggagtcgtcgtcatctgcagaaagtgctgcaggaatatctccacgccgaaattggtgagggcagaaccgaaaaatacgggagtcaaatctccccggcgcacttcttccagatcgaactcagcgctggctccgtcaagaagctctatttcctccttcagcttgtccaatgcctcctgtcctatatattccagcagacgttcttcatcctccatggggatttccagggtttccccttccttggtgcccttttccgtatcggaataaataatcacacagcttttatccctgtcatatattcctttaaatccttttccagaaccaatcggccagttcttgggacaggttgctattcccagttctttttcgatctcgtccaggagatcaaaggtatcgttggcatcccggtccattttattgataaatgtaaaaatggggattttgcgcatgacacagaccttgaagagctttcttgtctgtgcctccacacccttggaaccgtcgatgaccatgactgcggaatccgcggccatgagggttctgtaggtatcctccgagaaatcctgatgccccggcgtatccaggatattgatgcagtatccgtcatattcaaactgcaatactgatgaggttaccgaaatacctctctctttttctatttccatccagtcggaaaccgcatgtctggcagtcgcctttccttttacacttccggcaaggttaatggcgcctccatacagcagaaatttttccgtcagggttgtctttcccgcatcgggatgagatataattgcaaaggttcttcttctgttaatttcctgagtcaggttgctcacttttatttcctccagttgttatggttttccgggcagctcccggcagggtatttttgcatatggcacatctgtcacctgcgcttaatggggaagcatgcttttccctttaaactgcggtgtgattccgaaataatccagaacagtagcgccgatatctgcaaaggtatccctggttccccagttaacaggcggtatattcctgccataaagaaggaaaggggtatattccctggaatggtcggtggaaaccgtatagccgggatcacagccatggtcggcagtaatcataagaagatcctcatccttcagcctggcgagcagctccggcagacgctgatcaaaataagtcagagctttggcataaccgtcaatatcattgcggtgtccgtaaagcatatcgtaatccacaaggttaataaaacaaagtccccggaactctttgtccatatagtcaagcgtcttattaatgccgtcttcatttccctgggtgtaaacatattccgtaaggcctttacccgcaaaaatatcgtgtattttccctacaccgattactgcacagccgttttccttcagctgatccagcatatccacagaaggcggttctatggaaaaatcatggcggccggaggttctggtgtaattgccagcggttcctgtgaacggacgggcaatgacacggccgacaccatgttcacccacaaggatcttacgggcaatcctgcagtattcatacagtgtttccggaggcacaatatcttcatgggcagcgatctggaatacgctgtccgcagacgtatatacaatgagagcgccggtccgaagatgctcgtccccgtagtcccgtatcacatcggtacccgaatagggcttgttgcagagtacgccgcggccggtcagccgggtaaactcatcaagcacttctgaaggaaaaccgttgggataagtaggcagcggacggccggaataaataccggcaatttcccagtggccgattgttgtatccttgcctttggaagcctcctgcatacgggctaccgaagccatgggcgcttcacaggaaggatgatagtctattccttctatattaaagagtcccagcttttccatattaggcatgtggaaaaaggaactggtggatgcacttttcagagtgttggtacctgcgtcgccgtattccggggcatccggttcggcgccaatacctacgctgtctaaaacgatgagaaatattcttttcatggtttggggctcctttcatttatggttggatcaggaaaatctgattattgactgcggacgggcagaacccagagaacacaagtgtcctctgggtcgcttcgctcgccagatgggaaaagagaaggggctgaatcggcaggcagtccagccttttctcttttcccatctggttctgccctgttcgaagattataccacaaatccttcttttgtacactatttacttgatgtattttcttatgagagcagtcttcttttgatatgtatctccctggaataattgtattctcctatatattaattcccggtaatagggctgattattatgttttccggggaaattcctgtttttcttgtcacgatatcctctatctgggctctctgtgcatcggtcaggctgggggcattgaccaccacatccacaccagatccgctgatgctcaccacaacatcattaaaacctttggcttccagaagaatttctgcagccgtttctttttctgccatatcggtaagtgcaatcatgccgtttatcgcatcctgcttctgttcttcactgatattagcgttgtttataatatccagaagggtctctttattctttgctcttgtctgttccttctgcagcttggctcccgccagagaggttactcctgtagaactggtaaagacagcttctccgggaacttccccattctgtacatccgtatcctccgctacctgctccgcgctcgcttcatccatcgtttccgataccaccgccacctgggcgctgtcagcctgtacctgggcattagccggcatctgctcgttgaggtaatctgctgctgccacgccgtcctgatcggaatccatactgtctatatccgacaccacatcttcctcagacaaatcaagcaaagcagtcatatcctctcctgcgtttccggcatccgcgctggtaagctgttcttctcctgccttggttcctgcaaaattcaggtaccctgccaccgcaatcataattgccagtgctgtaatcattatttggttgcgtttcaacacattcttcactcctgttccctctgctttctgctatttcatcttaactactttaatcttatgtgcctctactccaaataatgcctgaatcacgtccgtaatatttttctgtacaacagcatttccgcctccctgggcgaccaccgtaactccttctatggcaggctccagggttttactgatatagggcgttttgttgccggcctggtcggtcacatacacggtggtttcctcctgtttggaattcaccacatcccggctgccgccggcactgtccgtttccttggtagtatccatgctgtaggggacgtctttttccaccacctgttccacagaagaggacagagttaccatgacctttacctctcccacgccatccatgctggacagcagcgcctccagacggttttccacctcctgtgtgtagcttccgtctccatcgtctttttccgtttccgaggttttcatcgtatcgcttcccgtgtccgataatccggtctcgtcccttgcattttctgttttctttacaggcagggcaatcaccattaacaggattcctaaaagcgccaggattgccatattttctttagtcagctttttcttccatgatgccaggcggtcacccattccatatcacctccagatttccactatctatgccaagcgcctctgcaaaagctgccttcatctgcatctgctcttccgctgtccttccatttcccgaatcctccgcatctgtcccttctcccgacgggttaattgttatattttctatagttaccagtctgcccccggcgcctccttctgcaatttccacccggagctttccttcctccggagcggatacggctttcaaggatacaccatattgttccattaaaggctctaatttctgccggaccgtcatagaaagggcttcttcctggtaatctcggccctcgaagtcgctctcctccacctgcatgccgattttttctatttcctgctcatacttatccattgcactgtcgtatacgcccgccgcatcaaacttcccaaaagataggatgggaaggacgatctgggataagaccataatgctgatcatcatcttcacatatttttcatatcccccggcaggcagaaaatgcacgataagctgtcctgcaagcataaaaactgtcactttcttcaataattcaagaaattgagcacccatttttcatttctccttcctgccatcctttccgtttgttatcgtcccggccgttccaagcagtcagcccattctgcctgccaggcatgtgataatggcaaacataatcaggaagcaggcacaggctgtgaaggatatccgcaaaagaagaagaaggccgtcaccggctttattcacacagcctgttattcttttatccgccgtcatgcccaggagtgctgcacaaagcttcagaatgcctgcatataaaagcagtttggcaaaagggacaatgcataaagccagcaaaagaagaaaggccgccactcccagtccgttttttaccagaaccgccgaaccgatcagcagctgtgccgttccctccgccaggccgccgaggccaggaatcgccgacagggctttgcccgccacattcagcttcagctgttcgagtaccggcgttaccatggactggagaaggccgatgcctgtaatacaggtaagcatgaatttcaggaagccgccgattcccttttgcaggagatccacaagcatgcccagcttttcctcttcccagactccgttcatcaccaccagcatcatataaatattcaccgccggaaggccgatactcacaagaagctgttccacgccatagattaaaagcagtatcagctgataataaccggcggccgtagccgcaccggaggacagccctaacgccagcataaaggtggggacaaacaatcggacgaacagtaatatcctctccagcagaacccctgcaatatccgcagcctgggtaaacgtcctcagaaccacaaacagcatgagcagataggaaatgaagtgggcgatatccgctatctggtggttatcaaagctttgcatcaccaccgtaaacagggcggacaggactccgataatcagcaacgtgagcatgagatttttcattccgcctatctccgccagtattccgtttcttagggaagagctcagcccccggaaggcctcccccatatttccggcaagtacctgtccgaaaaaagaggtaaaatcaatgctgaaatcaggaaaaagctgctctatttgatgggaaaggtcatccagattcaattctccggccagcgtcgtcagttccatccgttttccctctatttcataaatcccgttatcgtatccatcagagacaaaagcacgggcatgcccgccagcaggatcgtcaccttaccgaacagctccacctgggccgcaatagcctggtatcccgcatctctgcagagtcccgcacaaaactggcagagataagtaatcccagtgactttaaacaaaatactgaaatacgctccgcttccttccagaaaacctcccagtgccagtacggaatccttaacctgtgtgagatactgacatacataataaaaaatgatcaatgcaacggcgataccaatataagcgctgtattcctgctttccggatttaaactgcaggcctatcagaacgccgatgataccaagcaatgcaatttttgccatatccattccctgtcccttcctttctgtcagagctgaaacaggttctgtatcgtagtgaacaaatcatatatgtagggaatgacccaggtgagcaccagtatcagccccgccagggaaagaaggaatgcatgttcctccctgccgctgtgttttaatatctggctgaggatggtgaccaggattcctaccgccgctattttaaaaataagacttactcccattccattctccttcaaagtcatatcagcagtatggcaatcaacagcccgccagccatacttacggaaagaaccgcctttttgcggctttctgtttctttcctcgctttttcttccgcacgccttatttcttttccgaactgctccagagatatcagctgcatctgcccatccacaaagccggtgaatccgggaaaagaaagcagcagctcctcttcctttttatccaggcaggtttccttcagaaatcccgcaacttcttcatcccaggctgctgcgaatgtgattccttccggtccctgtgcttttttccctacatttataaagcattcgcccagccgccctcccaggcggtttcccacacgaatgagcccctccggcagggtagccctgctgtaacccacttcactctccagcatggaaaaagctctggaaaggagatgaagctggcctatatgtctttccatatccctgcatgtacaccatccaaatccggcgcagcccagcaccagcagcagcgcaccggaaagcttcatcataatggtcctccggacagtatcctctgttctttgtccaggacagcctccacttcacactttcccagcctcctggtcaggacgatataccgttcaaagaccttttcacccgccagctttctcataaataatctttccgcagcctccgcggcagaaccggcatggatggtagccaggatggcgcatccgcaggaaagtacttttttcatggcgtctatatcttcttcacttcccagttcatccactccgatcactttcggagccatggaacggattaacagcatcattccttccgctttgggacagctgtccaggatatccgtacgcagccccacatcattctgcgcgcgtccctgaaaagaacctgcaatttctgaacgctcgtccacaattcctaccgtgacgcctcccccataagggtttccgtcagaaacctgccttatgatatccctcagaagtgtggtctttccgcagccgggaggggaaataataagggtattcaggaatcttccctcccgataaaggaaaggcagcacagtatcggccgcccctttgatttcatgggaaatccggatatttatacaggaaatatgctttatgtttcgtattttatctcgttccgagagaactacttctcccgccagccccatacggtggcctcccggaagtgacagatatccccggcttatttcttcttcaaaagcatacatggaataactgcaggtataggaaataagccgttccagctcttcccgttccataatttccgcctgttctgtacggcttactatttcccctcttttatccttgaaaaattcttttccgtctatacaaagcagtacaggcttatccgcccgcagcctgatttcctgcagccgttcggcatagcctgccgctttacgccatttcccccgcatttcttccgggaatatccgtaaaacatcttcttcgctcgtcatgggcacacttcctttcccgttcattcacatccatggcagtctgtccaacattccatgaaacactctgcttccattttcagtatatgtgtgtcatgccaggttatgactcctgagagacacaaaaaaagccggaggaatgcttttaccgcattcctccggccataattcgtaattattttttatacctgtgcaacatccttcatggagaagctgattcttcccatcttgtctttgccaaggcatactacagtaaccacatcaccgagggtgagtacatcctctacatggttaattctttctttggcaatcttggaaatgtgaaccataccttctttgccgggagcgaattcaatgaaagcgccgaattccttgatacttactaccacacccttgaagatctggccttcctggaaatctgtggtaataatcttaaccatctccacagccttatccatcatttctttgtccgttccgcatacggaaacctttccgtcatcagtaatatctatcttcacgccggtacgggcaatgatttcattgattgtctttccgcgctgtccgacaacatcaccgattttttcaggatcaatctgtacggaaatgatcttgggagcataggttcccacttcggctctgggagcggcaatacagggagtcatgacttcattcatgatgtattcccttgcttcttttgtcttggcaatcgcttcttccacaatgggtcttgtcaaaccgtgaatcttaatatccatctgaatggctgtgataccgtcatgggttccggccaccttgaagtccatatcaccaaagaagtcttccagtccctggatatctgtgagtaccagataatcatcatctgtatctccggtaaccagaccgcaggaaatacctgctacctgctttttaatcggaacacctgccgccatcagggacagggtggatgcacagatagatgcctgggaggtggatccgttggattcaaaggtttcggatacggtacggattgcataagggaattcatcctctgtaggcagtaccggaatcagggccttttccgccaatgctccgtggccgatttcacggcgtcccggtcctctggagggctttgtttcacctacggaataggacgggaaattatagtgatgcatatatctcttatttacttcattttcatccaggccgtcaattctctgcatttcagaaagcggagccagggttgttatagtacagatctgcgtctgtccacgggtgaacattcctgagccatgaactctggggatgatatctatctccgctgccagaggacggatctgtgtgatagcacggccgtcgggacgtttgtgatccttcaggatcatcttgcggactgttttcttctgatactggtaaatagcctctcccagtacaggaagccattcttccttatcagcgaaggcctcttccagacgggctgtgatatttctgatattttcttctcttacctgcttaacatcggtaaatacggcctcttccatttctgcaggaggtacgatttccttaatggctgcaaacagttcttccggaacggcacagctggtatactcgtgcttgggctttcctaattctgcaactattttattgatgaaagcaatgatagtctggtttacttcatgagccatatagatggcttcaatcatcttattttccggcacttcgttagcaccggcttcaatcatgataaccttttcgccggtggatgccacggtaagggttaagtcaccgttcttccactgctcctgagaggggttaaggacaaattcaccgtcaacaagtcccacctgggtcatagcgcaggggccgtcaaagggaatatcagaaatacttgttgcaatcgcagcgcccagcatggccaccaattcaggacggcaggcaggatctacggaaagcaccaggttattcagggtcacatcatttctgtaatccttagggaataaagggcgcataggccggtcgataacacggcttgtcagcacagagttttcactcgcttttccctctctcttattaaagcctccgggaatctttcctacggagtaaagcttctcttcatactccacgctcagggggaagaaatcaattccttctctgggcttttcgctcgctgtggcggtggataaaacagtggtatctccataatgcataaatgcagccccgtttgcctgtgctgccactctgccgatgtccacactcagggtgcgtccggcaagttccatggaaaatgtcttgtacatttcgtctctccttttctgaaccataaatattttgctgtcatgccgccatatgcagccagacaatcaatgggaagagcggacaaaccacccttcgtaagcggacttctccgcattggtgctgtccaggcagaagatgccgaaactactgacaaaaccgcttacccggccccaagccgcagcaaatgcccttgtcagtggtctcggaagcactcttccgacctgaagaagcagaagacgtcacccaaaacagatgcgccttttgtacggtatggagttttcctttaccgtacaataaggcggaaagctccgaaagtatccggagctaaatccgccttgttttgcagcattattttctgattcccagtctttcaataagagtacggtatctctcgatatcttttcccttcagatagtccagaagacctcttctctgtccaaccatcttaagcagacctcttctggaatgatgatccttggggttgctcttcagatgctcggtgagttctttgattctttctgtcaggactgcgatctgcacttccggtgaaccggtatcgccttcgcctcttgcatactctgcaatgattgctgttttcttttctttggaaatcatgtgtgttcctccttgatttttaatcgcctgataccaggataaggtcggagtgtcctgtatctgggtaccggctgaatttcataccagaaaagtataacacattcatcccattcttgtaaactattttcttgtcacatcagaaatatataacatcattcacaccagtttactggctgagcacacgcttcaccgcataaggtgtacgataacttacattggaaatcttgataccggatctggggttgctggcatggataacctgcccgtttccgatataaattgccacatggtttacccttccgttctgtgcatagaacacgaggtcgccaggcttcgcctcagcaaggctcacctttgtccccatagtgctctgggatgcggaggaatgaggaagggaaacgccataatttttaaacacactcatagtaaaaccggaacagtctgcaccgttcgtcaggctcacgcctccccatacatagggacgtcccagaaactgcttcgcaaagttaaccaaatcaacacggacatcggaaacacctttgccgtatttcagttcggtctgtgttaccgctctgtcaagcttcttggcaattgtcacataatcagcggatacaaaggcttcctcatcatcaagcatgattttcacccatccgtccagctgctccacaacttccagttcttcgccttcggctaccagtgtaatgacagggctttccgtactggcctcctgccttacacgcaggcctcccgaattgcataccgccatatccgcagccactttatccgctctgtctctggcctcctgcccggtcagcaggaattccgccttcacatagccggtaaccttgccggatttgatacgtgcccatccgtcttttatttccagaacctcacagccgctgttcttactcattttaccaaccagcttgccgtcctcaccgggttcttccctgacattcaaataatcgttaacattagcaatccccaggttgctgaagccataaaccgcttttctttccaccttggcttcttccgcggccgccagataatcctcttcctgcagcttcgcttccagaatctcgcccacacctgccgaaggcaccggcgcgttccctgttcctgtcgccgaaacagtcatgcccgtatacaatacaatccctgccgccaacataccgattgcttttgttccttttaacatataactccttctcctatttcttaatctgaatatgtactcttctgttccatcttccataccgccggaatattttacagattcctttcaaattgttacaatattattacaacagtattatattaaaaaccctctctcctgtcaattcctaattccttaattttacaggaaatacctggaacttcgattaaaaaagactttcaggagaaaaaagacctccggccgccacagtattccgtctgcagcggccggagggggctttttcccgaaaggccatactttttatattacgttactcacttcatattctgtattatccatcgcaaaagcgatgttcgttgcatgatccgccactctttccaggccgctgacaatatcagaaaagatcatactggcctccggagtacagaggttctttgtcatccgctggatgtgtgacttctgaatttcccgttccttttcatcaatcgcatcctccagctgccgcacatcctctgacagttcatctgtgcctgtggaaaacatttctacggaaaaacggattatcgtatttaccatatccagcatttctcccagctcatgctgtgcctctttgctgaagcttacgcctgtttcctttctccttttcgccgcatccgccacattttccgcatgatcgccgattctttctatatcgtttactatatggaaaagggcgccgatactcttctgatcctcaataggaagggttgtctggttaatttttaccagataattggtgatggaatggttcaggaaattaatatttttttccaccgtatatacggtatcaatatcctcttcatccaaagtgatcaatgcattcatggcacggttcaggttatcggaagcaagagtcgccatacgtttcagctctttatccacttccaccactgccgttgcagggttgaatactgtcttgtctccgatatacttcaaggtaaaattatccctgtcgtccattttgacatcatcacccggtacaaagacataggtgagcttcacgatcagcccggcaaaagggaaaagggctataacctggaatattttgaatatggtgtgggcattcgccacaaaacggccggaattggtgcccgataccatgtgcagcatatccatgacaggattcatagccagcttcaggatcagatacatgagaacggtaccgattacgttgaacaggaaatgaatcatcgccgcacgcttggcatcttttttaccgttcagggaggcgagaagcgccgatgtacaggctcctatgttacagcccagaacaataaaaagacagataggaagctccagaaggcccttgtttgccatgagcagcacaatgctgacggttaccgaagagctctggatcactgccgtaagtatcgtccccaccagtatggcaagcatggggcttgtaagggaggacaggatatggacaatttcaggcatatccctcatacccgacatggcgcttgacattccggacagacccatgaacaaaacaccgaacccaaggacaatgtggcatatttttacgatactctgacgtttgcagaacataacgcccagaatccccgcaagcaggaaaacaggggcaatttcagaaaggttaaaagatacaagctgggaggttaccgtggtaccgatattcgcgccgaaaataacgcccgccgcctgatacagattcatcagccctgaattgacaaagctgactaccatgaccgtacatgctgaggaagactggatcaccgccgtaaaaataatacccaccagcatacccaaaaagcggtttgtggtaaacatctccaggatgcccctcagcttggctcctgccgccttctcaatactctcgctcatcagccgcataccaaacagaaataaaccaagtcctccggccattgacaacagcatcgcacctatactcatctttcgtctgattccttcccaccccgcgaaaaaggcctttcggccttctttccagagtttacaatatacgcattctttactttttatttacacacactttacatacattttaagggattcttaagaaagatacaagtaaaataaagaattttgtcaaaaattgaaaatagaaagttacaattcaagtccccggtgccgccggtcttatgtttctgccagcccggcattccctgccctgtatgtggagtgtgactctgcaaggattcctgtatgggccgtataaatacgccggtccttaggttgcgtactttgcaaccttagtaccgctgcgtatttatccgagcgaaagtgtgccctgacaggaaccttgcagagtcacgccccacatacagggcagggaatgccgggctggcagaagcataagaccggcggcaccggggacttgaattgtaacagcacgaaccgccggacagttctcccctaaacgggaattctctgtccgacggttttttctgctctgcggctttcccagtaatctctgcctgcttcaatatcccgggccatattttcttttaattcatcaacacctgaaaatttcatttcaggacggcagtaagtaagaagagaaacctccacatattccccgtagatctcttcattaaagttataaagataggtttccacactcatctggccgctgttgctcaccgtaggcctgcagccgatgttggtaattccttcatgccagcttcctccggcaaacatacgggaaatgtagactcccttaggcggaagaagcttgtccctgggaggcagaaggttaaccgtgggcatgcccagcgtccttcccaggcgtttgccgtgctttacggttcccgatactgtgaacggggcacccagaagcttttcagccagttccatatttcccttaagaatctcttccctgacaaaggtggaactgatttcccgtccgccgtacatgattttgtcgattacctgtacctgataacccattttttccgccatggctttcagcaaatgccagtctccctttcctctgtctccgaaggaaaggtccgtaccggccgcaatataccttgccttaagctgctcatgaaggaccctgctcacaaaggtttccggaggcatcgcggctgtccgggcattcatgggaaattcaaccagaaggtcgattcccattttttcaaaaatacgccttttttcttcctttgtcgtgagttctgcctgaggctttccagagaagaaaaccgacggcggcgggtcaaaggtgaataccgttgccgcaagtccatcttcctttgccctgataatctgatccagaagccttctgtgcccctgatggatcccgtcaaattttcctattgccacagctgtatgctgttcccaattaatttccgtagttcctgaaataatctgcattaaaacactccagtaggcataaatgccctttattttacagaaacatctttaccggctgataacgccctttttcatccgaaaaggcatatattccgtaaaagcgtccctccgtatcatacactttcacccggatgccgtcaaccgcttccagctcttccctgacctgattggaatagaaagaattcccattctccagaagacggcggaaggaatccctgattgtaagacatggcagctccgggaacatggcatctgccggaatcacatattcctccagcctgccttccgcagccagtttttccagttctcccaacggcagggcatcatctatggcaaacgttccgaccctggttcttttcaggctcttcatggttccgccgcagcccagttttcttccgatatcgtggcagagtgtacggatataggtccctttggagcaggctacccggaaggttatttcaggcagagcgacagaaaggatatcaatccggtggatttccaccggccgtcccgcccgctctacctcttttccggcacgcgccagctcataaagctttttgccgtttactttcaatgccgaatacatgggaggaatctgctcatagcttcccaaaaaagaaagaacggcttccacagcctgttcctcttccataagtaccggatgctcctccagtacctttcccgaaatatcctgggtgtctgttacctttcccagaagaagcaccgcttcatattccttgcttttatccgtgagcatatcgcagagcctggtggcatttcccagacaaacaggaagtaccccgaccgcatccggatccagggtacctgtatggccgattttcttctgcctgcatatgccgcgcagctttgccaccacatcatgggaggtatagcccgcttctttatagacattcagaatgccgtttatcatgtgtcctgctcctcaatgaattgtttctcaatatgtaatgagaggttattgatcacatcgtggctggtgccgttcattgtacagcctgccgcccttacatggccgccgccgccgaaataggaagctatctttgaaacattgatccgcccgccggaacgcaggctgaccttatattccagaactcccgtttcatacatgaaaatggcacattccacgcctttaatgctgcgcagctggctgacaattccttccagatcctgggaggtggcttcataaaaatccatagtctttttatccagaacgctcaccacgcattttccatccagaaaccgtatgctttccagaagggcacgccccagtatctgcgtctgcagatatgtcttttcataaaaggtttcttcaatcagccggctgaagtcaaatccgaaggaaatcagatgtgccgcagcacgcagggtttccggtgcggtattggaatactggaacaccccggtatcatggatgatgccgatataaagggctttggcaatctcctcatccagctgttccccatcaatcagattgtatatcagttcacttgtggagctggcttccggtatcacataattcacatcaccgcagccgctgttgctcacatggtgatcaatgttgatttttttatctgccgtgcagaaatactcttccgcctggcccagacggtcagaggcggtatccagacagaagaacacatcgaatttctcctgttttccgtaatcgctgtcgatttcctccacaccgcggatacaggaaaaaatatccgccggtttttccaggaaaatatggatatccgcatcaggccttaccttctttaaataaagatataagcccatacaggaaccaatgcagtctccatccggacggatatgtccgctgataccgatccttttcgcctgtttacattcttccaaaagcttcataaatcctccctgctggaggcagggaacgcttattcctcatcggcctccgcgtcccgtgccatatcctggcttcccattacttcatcgatcttatgggacatatttacaccataggcaatggactgatccataataaactgaacttccggtgtaatacgcaggttaatttcttttgccagcctgctttttataaaaccggaggcgcttcttaagcctgccatcgtttccttctgggcagcttcatctcccagaacgctgatccatgccttacatgtcttcaaatccggggatacctccaccgccaccactgaggtgaggggggcaatcctgggatcctttatttctccccggatcgtttcggcaagcaccttctgcacttccgaattaatccgggtattttttacactgttttttctcattgcaactcctacctgtcaggaatccatccgttaacagaccggctttacctgggaacctctaccataatgtaggcttccacaatatcgccttcctgaatctggtcgaaaccatcgaatacaaaaccgcattcgaatccggaacggacttccttaacatcatctttaaaacgcttaaggctagccagagaaccttcatatatctgatcgccgtctctggtaattctcaccttacaatctctcttgaactcgccgtcaagcacataggcgcctgcaatatttcccactgcggatgccttgaatatctgacgtacctccgcgtgtccgataaccttctcctcaaatacgggatccagcatacctttcattgccgcttcaatatcctcgatagcctgatagataaccttatagagacggatatccacgccttctctttcggcagtggcctttgccgtagcatccgggcgcacattaaagccgataataatggcattggaggttgccgccagggtaacgtcggactcgttgatggcaccgacgcctccgtggatgcattttactaccacttcttcattggtcagcttcagaaggctctgttttaccgcttccacgctgccctgtacatcggccttgatgatcaggtcaagttccttcaggttgccttcctgaatctggctgaacagatcatccagggacatcttggctttcgtttcttccagcttcttttctttattctgtgtgataaaggtttccgcataggtacgggcttctttatcattctcatgagccaggaatacttcgcctgcattaggcacatcggaaagtcccagaatttccacgggtgtggaaggtcctgcttctttcgctcttcttcccttatcatcaatcatggcccttaccttaccatggcaggctcctgcggaaataaaatcgcccacatggagagtacccttctgtacgagtacggtcgctaccggtccgcggcccttatccagctccgcttcgataacaagacctcttgcctgtctgttgggattagccttcagttccatgatttctgctgtcagcagtatcatttccagaagctggttgatcccttcgcccgtctttgcagatacctgggcaaatacagtgcttccgccccattcttcaggaatcagttcatattcggccagttcctgcttcactctgtcaatattggcattgggtttatccattttatttacggcaacaatgatttcaattccggctgccttggcatggttgatagcctcaacggtctggggcattacgccgtcgtccgccgcaactaccagcactgcgatatccgttgaattggcgccgcgcatacgcattgcggtaaacgcctcatgcccgggtgtatccaggaaggtgatcttctgtccgtttatctgtacggtataagcaccgatatgctgggtgatgccgccggcttccctgtctgttacattggttttccggatagcatcgagaagggaagttttaccgtggtcaacatggcccataacgcagataaccggcggtctggaaaccatatcctcttcgttttcctcatcctctttcagcagttcttcaatgacatccacctttacttctctttcacagatgatgtcataatcaatcgctatattctccgcatcctcataggaaatttcctggttgagtgttacgatcttgccttccaggaacagcttcttaatgattgccgcaggctgcagcttcatcttatcggccagttctttgatggttatcgtttccggcacggtgatcactttaatctgctcttccttcacctcttctttaacgggttcaggcttaataaatctgccgggcttatttttcagtttgttctttgcttcgccgtcctcttcatagatgaggtctttcttgctgcgcttatctctttcctgagcgctgcggcgtttttcttcgtctctgtgcttctccccttctttaatggggctttccgcaacaaaacccttgcccggtgcgggcttcctgaatttattgtccatggaacgcttagcgtccggccttccgcccgtaccctgtgtacgttctccctgaggacggtcgctatttccgccagggcggccattgtttccgccaggacggccgctgtttgcattacggttaaagccctgaccaggcctctgaccgccgttatagccgggacggctctgtccttccccgggtcttccctggggtctgtcgtttctggggcctcttgcatccggcctgctgccctgcgcgccctggggtctgtctgtcctcggccctctctgctgctgccgatccgcgtagctgcccgttctgccttcatttcccggacggtttccctggggcctttccggcctgctgtccggctgtctttccggtcttgcatcacttctgttttcattccgttcagcccttgccgctctctctgcgttcgctttttcttctcttgctttctgctctctggccgctctttccgccgcctccgcacgtctgcgctgttcctccagcctttcatccggcatctgaggctgggaaggcttggtcaggggcttaatcagcttgggctgttcaaaaccgattcttcctgaagaacggttctgattgccgttctgacggtttcctgccgttcttccggctccgcccgcattattatttccgcggcccccattggaagcgccgcctgcgtttcctctgtttgcgttattggaaggatggttcccattgccccttctgtctccattattaccagctgctccgcctttattcccgccggaattctgtctttggccgccggtctgcattttgctgttatggggattgctcacaaaaataatatttttctttttctttaccggtgcctctcctgctttttctttcccgtcggcaccgccgtcatgagcctgaggcgcagcaggcgcctgctcctgtgccttttcatgactgccgttctgctctttttctgtcttcgtttccggcgtaacgcctgtcgtcttcatggatgcatcttccactatgcgtttttctccttcgcttttaccaaaatgtttctttaccatcattgccgcatcatcttccaccgaactctgggccgcttttgcttccacccctttgtcctgaagaaaagtaagaatatctttgctgtgtatatccaactcttttgcaagttcaaatatcttcgtttttgccatgctgttacctccgtctacttggcttcttccaaatgtccgattaggcttttggcaaacccgtcatctgttatcgccagggatgccctcatttcctttcccatcgcgtggcccagcccctccttggtatcgtagaggtagaacggcacatgatagtactcgcacatattccggaaattcttctttgtgttgtcggaggcatcgtttcccactatcaccaggcgggcggcgccggatttgacgcttttttccgtcataaactcaccgctgaccaccgctgaagcgcgggttgcgagaccgagcatggataaaatcttattctgcttcaaactcctcaaactccctttccagactgtcataaacttcatttggaatattcattttaaaagaacgctccaatcccttgctcttccttgcctttttcaggcattccatggatttgcacagataggcgcctctcccattttttttacctgtcacatcgaggacaatgtctccctctgcggtccttaagacccgcatcatttcttttttacctttcatctccccgcagcctacacattgcctcatgggaaccttcttattcatagttctctccgttatcctctgtcagagtttcttcggaagtctcttcatccagctcctcatcgaaggtttcctcttccggagcttctgcactgccttcctcggaaagctcttcaccggcttcttcatagccgtcttcatactcttcttcgaattctccctcttcctcgtcgtattcatcatccagataatcttcataccggaatccgggagcatccttggcctgggtttcactcttaatatctattttataacctgtcagccttgcagccagtctggcgttctgtccttccttgccgattgccagagacaactggtaatcaggaaccaccacctttgcggtcttttcatcgggatccgcaaatacagctacaatcttggcaggagaaagcgcgttctgaatgagattgccggggttttcatcccagtttactatatcaattttttcaccgcgcagttcatctacaatggcatttaccctggctccgttcataccgacacaggcgccaaccgcatccacgttgggattgttggaccatacagccatcttcgtacggcttccggcttccctggcaatgctctttatttccactgttccgtccttgatttccgtaacctcagactcaaacagcctctttaccagttcaggatgggtacggctcaccagaatacgggggcctttaggggtattcttcacttccagaatatataccttaattctttccgtaggcttgaaaacctcacccttcacctgttcgctttcattcaggagggcatccgcctttcctaaattaatgcttatgttcttacccacatatctttgcactacgccggtaaccacatctttttctttttcaaaatactgattgtaaataacgcttctttcttcttccctgattttctgcaggatgacgtttttcgcgttctgggtggcaatacgtccgaattccttggacttgatttccacatggatgacgtctcccacctttgccctcttggaaatttccagagcatcctccagagcgatctgcaggcagtcatcctccacttcctcatgtgtcgccacaatttctttttccgcgtatacaaggaaatcacaggttttccggtcgatttccacttttacgttatccgcttttccgaagtggttcttgcacgctgtaagcagagaattttctattgcttcgaaaagtgtctctttgctgatttctttttccttttccagaatatccagcgcttccattaattccttattcattgctttaacctccaaaaataattaaaaatcaaatgcaagccttatcagcgcgatttcggatcttgcaaaaactttttcttcttcttccgtttctataataacgctgtctgcatcaaacgatttcaggatacccataaattccttctgcttatccctgggcttataaagccgcagttccacttcttcacccaggcttttttcaaggtgtttatccttcttaagcgttctgccgagtcccgggctgctaacctccaggatatatgcgtcgtctataaagtccacttcatccagcttatcggaaagcgccctgctcacattctcacagtcctggatattcactccttccggcttatcaatgtatgccctcagataccagtcactgccttccttcaaatactccacatcgtagatctccacaccgttttcttccgcaatgggagcgagcagttcttccgtacggttttccaccgctttgccttttgacattcgttcaccagatcctttctgtattcagttgtatgttgccacatcaataaagaagagtggaccggaagtccactctactctagtaaccatattaaccatataatactatagcaccattgtatacaaaacgcaagcgctaatttccgggggattcgggggttttctccgtttccgatttcagatttccgataattttcttcgcacaggacagaaataccgccatttcttcttctgtaaatccctgccaaatcttctcgtcaatgagtctgaaatcctcatatacctgagcggccctgtttctcccttccttcgtcaggacaatcaggaaagaacgcctgcagtcgggatgcttctctctggtaatatagcctgcttcttccaggcgatccaggtttcttgacatagtcgccacatccatgaagcatttgtctgccagttcacgctgagtcacatgatctttctcatacagcttattcaggattctcggctggcccggtgacagtcctaaatcctgaaaataaggatgcaggatctgccttctggcggtttccatttctaccatggcttctcttacgtcccgcttttctatggaaatcctgccatccatggatatcttctcatccatttccatgtcactccctttctatttttattgtatcactttcatacctgtcattccagttcaaattgtccggtatacagccggtagtagcggcccttctgggcaagcagttcctcatgatccccccgttcgattatctccccctgctccaggaccataatcgctttggaattgcggacggtggaaagtctgtgggcaatgacaaataccgtccggccttccatcagggagtccatccccttttctatcagcctctccgtacgtgtatcaatggaactggtcgcttcatccaggatcagcaccggcggccgggaaattgcggccctggcaatggcgagcagctgacgctgtccctgggaaagattggagccgtcactgtgcagcatggtatcatagccttccggaagcttgcgtataaaggaatccgcattggcgatccgggccgcttccctgatgtcctcttcccctgccttcagccgcccgtaccggatgttgtccgcaatggtgcctgtaaacaggtgtgtatcctgtattaccatggaaagggaacggcggagatcctttttgcggatattcctgatatccagcccgtcgtaggttatggtaccgctctggatttcataaaaccggttgataagattaataatcgtcgtttttcccgctccggtggaacctacaaaagcgatcttctggccgggtttggcataaaggcttattttattcagaatcttcttttcaggagtataaccaaataccacatccacaaaacggacatccccctttaatggtaccagttcagaacttccgtcttcccgcggcaccttccaggcataatccctgccctcttcaccgttttcttcaagcacgccgtccttttccttcacatggcacagggtaatatttccttcatcaatttccggctcttcatccatcatttcaaaaatacgttctgcgccggacagggctgccagcagaaaattgatctgttgagtaaactggttcatgggcatggcgctctgtctcacatataccagataggatgccaggcttcccagatccatcaggcccgacaggacaaacattcctcccacgcaggccgatacggcataattaaaataggaaaggctgacaatagtgggaaccatcatgccggaataggacagcgctttggtggacgcctgcctgagcgattcgtttctcctgcagaattcttcgtaatcctgatcttcatgattaaacaccttttccaccttctggccgcccaccatttcttcaacaaagccattgatgcttcccaggtatttctgctgtgcaagataatattttttactgcgttttccattaaactggataaataggaacatgagaataaggaaagcaatcacgataagggacagcctgagattcaggataatcaacatggcaatggtgccggtaaccacaataaagctctggatcagaagggtaaagctattgttcagagcctccgtcagcgtatccacatcattggtaaaacggctcatcagctcgccatgggtatggacatcaaaataagaaacgggaagttcctgcgtatgttcgaacaaatcgcgccggattcggcctactatcttctggcaggtatggaccatgagctgattgtagccgagagtcgccagcgcaccgcagccgtacataaccgccatcagcactattatacggatgagtccgggaatatctcccggcaggatgtatttgttgataaccggcttgagcatataggtgcctataatattcgccagactgctgatgcataccagcagtgccaccaaaaccacggaccatttataaattcccatgtaatggagcatctttttcatggttttctttcgatccttgggacgtgcgtatccattgtatttcgccattacaaatcagctccttcctgttgggattgataaatttcctgatatatgagattatttttcagcagctcttcatgggtgcctgcggcatggatcttcccatcctccagaataacgattttatccgcatgcgccacagaggaaattctctgggcgataatgattttggtagtccccggaaggctctttgccatcccttcacggattttggcttctgtagccgtatccactgcgctggtggaatcatccagtatgagcactttcggttttttcagcaaagccctggcaatacagagcctctgcttctgtccgcccgaaacattaactcctccctgcccaagatccgtatcatagccattttccagcctgcctataaattcatcaacacaggcaatccggcaggcttcttcgatttcctcctccgtggcatcctctttcccccaccgcaggttatccctgaccgtgccggaaaaaagtgtgtttttctgcagcaccatggcaatggcgtcacgcagaggcttcagaggatactcctgcaccggatggccatcgatgcggatctgaccctccgtcacatcatagagacgcgggatcagctgcacaagcgtggttttcgcagcgccggtccttccgataattccgattgtctgcccggcctccattttaagggatatatcggacagcacatattccttcgcctggctgctgtatttaaaatacacatgatcaaattcgatatctcccttttccaccgtgatatctctggcgtcatcttccgtaatatcaattttttcatccatcacttcagtaatacgtttccatgaggtaagggaacgggtaaacatcataaatacattggatatcatcataagggaattgagcacctgaaggacatagctcaaaaatccggtcagttctcctaccttcatacctcccgccagaatcagatttcctccgaaccagaggatacaaaggatcgtggtatacatgacaaactgcatggcaggcatgttcagggatgcaacacgaaacgccctttccgaagttgtctgcaggccggcatttacttcttcaaattttgaaagctcataatcgccccgcacataagactttaccacacggatagcagtcagattctcctggatgatcctgtttaccagatccacagccttctgcatcctggcataaagaggacggacatggctgataataaggaataaaaggactcccagaaccggagccgctatcagaaatatcacggcaagctccttattgatataaaaagacacggcaatagccgttatcatcattacaggcgccctgcacgcaggccgcatacctgtggaaatggaattctgtatattcgtcacatctcctgtcagccttgttaccagggaagaggtccggaaccgatccgtgttggcaaaggaaaactgctgcagcttccgatactcattcttacggatttccgcacccactccctgcccgcacaccgccgcgaatctggcgctgcccacacccagcaccatggatatcaccgcgcagaccgccatcataagccccttctcaaaaatataagctttatccccgttagcgattcccacatccaccatatccgccataataagaggaataatcaattccaaaaaagtctccaaaacaatacaaaacaccgccagggccgtagccgccctgtactttttcatgtaagaaagcaaacgtttcatattacctccattttctgttacaatagttgcatctgcaattattgtatgcgcacattatttttttgtcaatactgtatggctggattgtatcaacagaggggactttttactacaattatatggactattttatcgtttcgtggtagactgtatatagttatatatcgaaatactgttttttcgcacactccggctgttcctgtttcccggaatgtccaaagcaggcgggagggagaagaaatgttggatgaaataacagactgtgcagtatccggctggctgcaggatgtttttttaaaggatgaggaatatcagaagctgggagaagaagaaaagaaggcggctgtggaatgttaccgccgtctccctgaagaatatcataatgtagtagagcagctgatggactgccataacagctgctgcgggaagctcattgacctggcttataaacaggggatgattgactgcgctcaattattgagagaactaaagatcaaataatttataaaaggctttccggggcggtaataaataatccagccggcaatcaggcggctggattattttgcagcaggacaagtgtattttttcgtatgtataccgttatcgttctaatcttttcttgcagtccaacagttcatagatttcagtgagcggttcgatcgtctttatatcgaacactaccggaaaggtaggaagcttgcccattgtatcggcatctccaatcagctgttttgttttttcgctcacattggcatttaaaagttccatacggttcttttccttaaaccaaatcgccacgctgaaatatccttcatatacatagagccaataaagtgttttctcttttttcgttccccttttggtcgtccaaaaatgctgtcctctggcaaaccatgccttgtaaggagtataccattgccactcctgttccatttccaaattgggcagagcatcctgaagagcttcatatgctgcataactgccgcccaatatattctccagcatttctctggtcggcatcacttcggggttttttagctgtaaattttcattgctgttcatcttgtgtactccctattttttttataatacaaatcttattgctgcgaacccatatttatctgaaatgtagaattgcaaaccaactgtccccaccttttgcccaatgatataattccgggctctgtaagcagattaggatacctggttactttcaattcagacgcggggaaatttctcctcttttttgaaattattataccatatgcagttaccgttttcatcattattaatatattctcatttttgttgtgtacccattattttcctgtttagcatataaaaacctccaaactttgagacgtttggaggtttgggcaacatatcttagcggttattgctttcggattcacacccgatatttttgtatctcatgcaggatatcatctactttgttatgtacagctattgcgttctgaacggttttaatcacagatggaggtgcatccatacaatatttataaatatagtccgtgtacctttgcctgtaatctgttaatgcgttgtatccgcttacaggattgtaccgtggctcttcccatgatgttaagggtgttccggcaggagcccctatttcatctaaactgaacaccggtacaggacttaaagcataaccatagtcagtaccgcttagaactcctgcatcatgtaaagtagcaagaatcgtagtaagatcaccttgctgcagcttcgtcatatcatacttttctgccagtcttttgtataattcttcttccgactcaaagttttcttcaggccataagccttttggcgaaatatttccttctaccgttgaataataatcattatcagaagatataccacaagggacacaacgtcttttgaattcttcaagagtcatcatggcccttgaagctttttgattttcctgtacataagaagtatatgttgctggcgttacggaattaatattcatgcgatttgctccctatcatcgtacaatttatcgtacattaaattacaatccggatccaaaaagaattcttctgctttaagaaaaaatataatccataacattatccagtttctcataaacagatgattgcttcataaaaaaatcagaaagctccgggtatttatttgcttctcccctttgaagtattgcgtaaatatgaaaggaactccttatatccatgtcatcaggatttggggaattaaaccagcttgtaactgtattttctttactggctacccatacaggcatatattcaccacatttagcctcttcatccgtgatcactcccatttttttaagatcattcataaacgcaagtgtttttttatcaccaatctttagttctaaagaaccatatttctcttttagatattgtttttgttctgcattgatgccatatcgttcttcttgtcctgaatcattaacaaaagttacagaatcaaggacttgtccaaaaagagatttctcatttttaagattattggagaatacagtcttaaaaggattacagcttccaagtcctcccagagaattaatcataaccaacctccttttcccaatacgtttttacgttactctatatatttcgtcttaatagtatataaattaacatcaattcggcagttttagtaattttattttttagtttttacttttacaataacttatttatttcgtttatgaaatgttagttaatatatatactttaaaagccacctcttatcggcagcttttaacttaagactgattatatcgttaattattttcgggcaataaaaatgcctgcaagccgtataactacgaacttccaagcacttttcgggttgggctgttaaattaacagtcaacagctcgtaggggaatcgaacccctgattccgccgtgagagggcggcgtcttaaccgcttgaccaacgagccattttccttcatgcagatttatttcctgcgtgacacttgtatatattataacaagtttccaaaaaaagcaagtacttttttcatttttttctcagccttttttatcggccggaaaaaccctgctgttttccgcgattttctccgcattctatacctgaactgcagtagaaaaccaaaatcacagcctgtttttccggccggtctcattataacatcagcctatttattattcatttccatgagtattgtttcagaagttcccgatattcctcatagtagtcacagttttcaaaacggaaggattccggcatggccatgatttcctcacgggagtatttctccagcacaggtttaaggatatattcctcttccatacgataaagaacccctcttaactgaaactgcagctcatacttcagttctttggaaaaatcatccgtataccgctttccgatttcatccataaactcatctgcaatctgcatctgtccgtaatgagaccacttcttacggatttcagatacaagcttcatccatccggtatcatttccagggtaggcaagtcccatccactgggcatctttatagctccacaatgtccaggaaagactgtgtttttgaaacagcgacaaggtctcatccagcaactgcatggtaaagggcagatcatcctttttaatatccactcccgcttccccgcagagtgccggccttccgaaggtatcccgaagggctgcaaagccgcttaactgctcgtccattttccggactctttccgccgcgtcataatccttgtttgtcagattctcatcccaaacagtaggataaaaatggaaggtaagcgccgtttgttcatcccggggcagacggatatccgtaaagtccatggagaagaagtccccttcgataaatatgatatgattgggatccacttcccgcaccgccgtcgtcacttcttcaaggaaagcattcagcagcccttcctttttaggcattaaaaacggttcattcagaagatcataccccagaaggaacggttcctccttataccttgcggcaatcgccttccacagcttcacgatctgctcctgaaaaatgcggaaatgccagaactgaggaaccccggtcatattgtcggaatgccagtccgggttctgcccgccaggcgtcgtatgcagatcaggcatgaggaaaatctcatatttcgtacacagtgccagcagccggtccatatagcggaagccttcctctctgtaggtatgaggattcaggtcatctataaacagcctgtagctgaagggaacgcgaagcagattcactcccgtttccttcaggaaacggaaatcctcatcggtgaggaaattcagaataaaagattcaaaaaatttctctccgtcttcttttcccagcacctcttcaaaagtctttcttatctgagcatccgttccgggaagcccgagcataaaatgctccatattcagccaggaacccacgcccagtccggaaaacagaatcggctcccctttataatagaattcttttccctttacttttacaaaatccataaccacttattccttttaaaatgttaattcttccaggcatcccttttttacaaaaacaggaatggcatctatgggagcatcacaggtaatcatgcatccgcccttgtatacgcttccgtcatttaagctgcgccattcaccctccggcagatacagagttctttctctctgcttctcataaagaatcggggcaaccaggatttcggggccaaacatgtactcatcttctgtttcccagcatttcccatcctccgggaaatcatagaacaggggccgcataaccggagtacccttttcgtgggcttcggtcataagacgttttacataaggaagcattttttcacgaagctccagatatttcttacagattccgtacacctcgtcaccataactccacacttcattttccgcaccgcttattgattttcctcctccggtagtgccaaggggttccttgaagggttcgcggaaaccatgcaggcggaatacaggacagaaagcgccgaactcgaaccatcttaccagcacttccttgaaatcctcatcataaatattaccgccgtggaagcctccgatatctgttgtccaccacgggatacccgccagtcccatattaagcccggcggcgagctggcttcttaaagaacggaagctggaatcaatgtcccccgaccacacaagagcaccgtatttctggcttcctgcccaggcacagcgaagcaggttgactatgttttcctgtcctgcctcttccattccctcataggccattcgggcatattctctggggaaaacatttccgatttccagatcggatcccaggtaaaagcgatggttgctgtattcataattggtgaattccggttccgcttcatccagccagaaaatacggatgccatcatcataataatttttcttgatcttgtcccatacaaattttcttgcatccggattggtaggatcaaaaacagcggcatctcccagctgatacattctctttccgaaatcgttgcggcttaaatagcccagttcttccatttccttataattttcactttccgagtccactgtgggccagatagataccataagcttgatgcccatgctctccagttcttccaccatggctttcggatccggccagtaatccttatcaaatttccagtctccctgatgaggccagtggaaataatcagctacaataactgaaatgggcagccctcttctcttatattccctggctacctccagcagttcctcctgggtctgataacggagcttgcactgccagaatccgcagccgtaatccggcatcatgggaaccttgcctgtggcatcagcataagcttcctcgatctctgccggtgtatcccccacagtgatccagtaatccatctgtcttgtggaaagcgcagtccactctgtcaggttttttccgaaggtcacactgcctatggccggattattccagagcatgccatatcccttattagaaagggcaaagggtatactggcctgggaattccgatgggcaagttccaccacacagcccttcatatccatgtaaggctgctgatactgtcccataccgtaaattttttctccgtcattgggttcaaaccttacggtcagtttataattttcggttcccataataggggtaaaggtacgggggctgatttccagtgcgctgttaaattccccttccacattttcccggaaccggttcctgtcaaattcttccagaaggagctctcctttctggttataaaacttgatttttcctgtcaccataagctcacagcggattttgccgtttacaatagaagcactttttccatccgtcttcagttccggtgaactggccactgccggaagaagtgcggaagtttcctcatcgctgttaaaggtatggttctgcgtagcccttatgcgcagactgttgggtccccagggttcaataacaagaagctctttgtcctgtctgcagtagattttgttgtcgattatcctgatcatatgccctccttatatttgatgcttaaaaagctgctgtccccatgatacaggaacattttcttttttcataagtacattatattaattacagaacaggatttctttctgattcttgaccttttctttaaggatcttgaccttttgcaaagccttccttcttacctgccctctttcaccgttcccatgtaaaatattatgaaaacagcccggccatgctgtttcacacgaccgggcttcataccgcttgcggcttattcagctcaatgcacccagaaaagtttttgcatatgccataagttccgtacgtttcttagtttcaaccggaatctgcatttcctttttcctggtttcccctgctttatcataacttaacacagcagtgattgtcccgcatgtcttatcctgttccgaacaaataagcagagttccgttttttctgtccgtatcaaataaaaacggatgtttgtcaaaccatacgcaggatgcgtccataactggctccagctccgcccagaaaggaattacccgacgctcatttaccggcaaatcaaatacacctgatgttatttcgttggatactgtattttccgccttatcccaaagccgcagccgtttttcctggagcttcataaaatccggaaatgttatcttcaaagtgacattttcaagcctttccgttcctccatttattaaaagaaaccgaagcaaaaatacgttacgctgttctgtcatccattccataaacggttgttcaaatccgaaatgattgaacacaatacctgtatcgtccgccagatatccggcttctacctcaggaatactaacaatttcctcctccgattttccgttataggcttccaaaatcaattcctgatcgggttcagccattccttctgtgtcttttatatcgccctgagcacctgcgccatatggccggcagccaaatacaacccggaatgcgtcctgactcttgttttttacaataagtgtactcttctcttctgtttcacggtaactgatatcgaatatacagtctcccaatctggcatctttccattggtagctgtcaagcattcccttcggtttaataagaagaagatgttctccggcatggaactcaattcccagccactgcttcatatactggacaatccaactgccctgcccctgactgcagcgggcgatcatacggcgcatattttccgctttaggccaccaatatagtgatcctgtctcgtcaaccgcaccatccagcatatttttaagcgcatctttcatctcacgctttgttatcacgcctcccaacgccgaaacgaaagcggttccgtccagcgcgccgccatacgggaaccagcgcagcacatccatttcaggatcataattggaagcgaacaccgaacgggcaaacctgtgataattcagccatggttcaaaggtataatcgtatatcccgtatacaggcgcaagtacgctggaagaatcctccccgtcatagtagaagaaatcttcgttcatataaaaatcttcctgctcacccaaattggttccgcccgtaaactgcggcccgaagggtccttcttttatcatagtatccaggatatcctgtttcagcttatccgcataagcacgtacggcagcaccgtcttcttttccaagtacgtcgcagagttctgcatacagcatcgatgcataccagaatttaacatttgttccgtgatcataccgcctcatgacaatgccatcactggaataccgggacggcacaagatttcttccctccgcgcggaaggatacaatggtattccatatttcagtcagtctttcccatacataaggattctcaatgaagtattctctgtcccctgtatattccatatattttcccgccatcaccagcggagccatcataatcggcacagaatgctcaggataaatactgaatctaggctcatttctgtctaccatatattcaatcagcttttgccccagttccggcaagatatgaatgaagctcaatgtagtgggctctacgtcaattccccacatgcgtccgtaacaatgggaaggagctccctgccagtggatcagtacccgccctgtttcgtcagtctggacacaattgaaatcatccaggatattgcggatatgcatatcgcggcttatgactgcaagctcctgatccatctgcgatcccacagtaagttttccaagtctgtcctcccagaaatgttccgtaatcttaatccagtcaagcatgtcgtgcatatataaaatacttaaggcagcactgattccgtccggcttttctgccacacagacataggattcttctatggattcttctccgggcttcagacatatctccttataagcaatccagttttcttcctctttaatccataccgcaccttttgcatgtattccggtatagccttccggcctctgcataagcagcagattccgatcaacctggctgtaaacgtaaggatagctgcgttcctccgctgcgactcccgcaagttcatactttgacataaatgcattatcgaacctgagaaccaatttcccacgaagttccgtttttcccgtatttttgatgtgtaacccgtaaacagctccggaaggcccgggaagaggcagagttttcatgctgtttctgcctgttttttccagaacaggagcgattgtgacagtatccatagtcagattttcatattctgttttcgtatagggcaggaagtcattaaggtatgtggtaacactgccgctgcaggcattgggcagtatgctgccatcctccagacgaagctcataccttgcttttccaaaaaacattgtgagatctacttgataatacatccccggacaggctgtaatatgattttgattatccataatcattgtaggaaggggatagtctttttcgtgaggagttgctataaaatgcagcctccccatagtatcctgtcctaaaagcactcttccgtttgactgcgtaaacaactgtctttcgctcaatgccttattatagctgtagctttccgcatcatattccgcccgaaattttttggatatataggctgtgtttaacaattcatcaaatttccccatcttcattacctcttttcatttttattctcttgctaacctttcacaccgctcattgtcattccttctataaatttattttgtgcaaacagaaaaacaataaggatcggagcgcttgccaccagagccgccgccatgagaggcccatattccgcactgttgcttgactgaaaatatgacagggcgagagggatagtcctcatcctttcattcgatgtcacaagcagcggccataaaaagttattccacgcattcataaatacaaaaataaccattgcagataaagccggcttcgtcaaaggcacaataatcctcagcaaaatctgcagccggttggccccgtccatcatagccgcttcatcaagctccagcggaatcgaatacataaaattccgcagcagaaaaatactgaaagcagtgaccatggaaggaaggatcatcgccgcgaaggtattcatcaatcccaatttatcaatcataatatactgaggaatgatcagcacatatcccggaatcatcattgtcgccaaaaacaccataaatattttatctcttccggtaaaacggattctggcaaaagcataagcggccaaataacctgttgcaatctgccctaacgtcactcctcctgctacaatacaggaattcacaaagaatcttacaaaaggcatatctgtaaaaaccctgatataattttggatgataaaaggcttcggtatccactgaatatcatatttccatatctgcgattcttctttaaaagatgtggataccataaacaatacgggagcaatcatcaaaaaaccaaaacatactgccaaaacagtccttattattttaaatagttccttctttgatgttcttttcattattttccccctaatattccaccttatttttggatatcttcatctgcaaagctgtcaggacaaaaataactgcgaacagcagccaggaaacagctgaagcataaggcatatcatatatttggaaggcctgcctgtaaatatagtaaacaatcacatccgtcctcttaatcgggccgccccctgtcatcatgaaaatctgatcaaaaacttgaaacgtatttataattgatataatcatcaggaactgcgttgtatttcccaaaagaggaaatgtaatcttaaaaaatttctttacgccgttcgcaccatctatttcggccgcttcatatagggtaacaggaatatcctgcagcgccgcaagataaagcaccataaaataccctatccacttccatacccccactattataacagctatcatagcaagttttggtgatttcagccatgctatatcaggatctatgccgaatttagccaggaacagattaaacagcccgactttagggctcagcataaacttccataccattgatattactactgatgaaaggataacaggaacaaaatacatagccctgaccatccctttcaaatgtatgcttttatttacaaggacagccagcaaaaggccgatcgcaagatggaaaaacaccgttgggaacgtataaatggcagttaccttaaatgagttccacatttccttgctttgaaaagcttttataaactgtttggcccctgcaaactgtaaatctgtaatatttgtgcctaccttctcctgcatactcagaaaagcactatagcaaaaaggatatatagtaaaaattgcgaaaataattacacatggcaggatgaatgcatatccccatatattatccctctgctgtattgtcagatttccggatttttttcgtttcatataggagtccctcccggatatttaattttattaaaaagcttttgccttaatcttatgttaaaggcaaaagctttttgctgctcttctttaatcaaaaggcaatctgttttaaagcttactgatatttactgataatatcctttgtctgggactccaactctgcaagagcatcttcacagctgatttctccataaagacatggttcacatacagcatatacagcctgggaccattcatcataccacggcacccttgcacggtatgcacaatgatccattgcggactgtgcaacctgcatggaactgctggcagataaatattcctgatatacttctgtttctgcaataggcttctgacagacaagttcaccctgctctttactgttggctattactacttcctcggacatcatatatgtaaggaactcaaaagccgcatcatttactgcttcatctttcgaatccacgatcatcatctggtcaccgccaaccataaccttagattcaacttttccgggcatcagccccgtacccagattttctcccaatgcctcctgataagtattgatgctccatgtaccatccatatacattccgacttttccattttcaaaccctttttccggataattcagagtcgctatctgagtatcagtcaccgaacctaccaggaactgaagggcttctataccttccggtgaattaaacagcggttccgtataatcatcattaaacagcgctcctccggctgactgtaccattgcctgccactcccaggaaaactgctcataatagtctcctgttattcctgtataagcgaagggaataatatcattaccgcatttttccttgatttgttttcctgctgcaattacttcatcccatgtagaaggcgggttttctgtatccagtccggcctgttcaaagatttctttattgtagaaaagcacatcacaatttgcacatacatgaaggcctgccactttatctcccacataagcttcttcctggaacgtatcataaaaattatcaagcttcaacgtatcactcttatccagatacggttttaaatccaaaagcggagccacactgtcgactgttgccgtcatgcatgtgtccaactggataacattaggcatttgcgcacttcctgcagatgcctgaacctgaattttctgtaatgtggaagcatgatccggaaaaacctctgctgtgacatgaatattcggatggtcggcattaaatttatccactgcatcctggtttaccctgtaggatttccagtatacaagttcaatcacgccttctttttctcccgtttcctgtactgaagaatctgattctgccgcaggctgcgggctgctctgggatgctgtgtccgaggcacctcccgaaccgcaccctgtacctccaagaagaattgcccccaccagtaaagctgcaactatttttttcattaagaaccctccctttcgttattttgtatattgttattataagcaaaggcagagctcataacaatttagttatttatcttgtttatataactttttttgttatttgctttatatatattgcatatttttgttctgatataattattttgctttgtatataattatttttacctttatatgattttcatcacataatcctgcctggtaatcaacggtatcctcagcgtcaccgtcgtgcccattttccattcgctttctacatcaattccataatcctgtccataaagaatccggatacgttcttcaatatttttaagcccgatacttcttgaatatccatgcctgtaatccgttatattcatcaactgctgtcccgatatgccgcagccgttatccttaaccgtaattatcataacgccgctatcctctgagacatctatatttatttcctttttataatgaacatccttaaagccatgaataaaactgttttccacaatcggctgaagcagcagcttcgggatcatgcagcattccagctcttccggacaattgacattcagaaccacctcatccagatgaatgatctcctctattttaaaataatgttttacattttccagttcttcctcgattgtgagcatctcatcggacacatccaatgttccgcgaagaagcttcgatagtgatgtaattacattattgatatccttatttctgttcagcagggacaacatttttatggaattaaatatattatataaaaaatgagtattgatctgcgcatgaagataattgatctcgtttatcttcttttctttctcctcctggactaattttgcagtataattctttatatcgcctaccatccggttaaagctttcaccgatttcatcaaattcgtcataataattcacttcatagcttaaatcgtatttttctccggcggcattttccatcagccccttcaaatatttgatgcgataagagaatttataggtgaataccaccactaatccacaggctcccaggcctcctattacgaaaataacaaacaaaagatccctggccgcagaattatttttgtctatacaagagatgggaatctgattaatcagaatccaattgcgagaaggaattttcatgcagttatagatataagctttatcctcatatacaaaggagactccttcattatccgacagaagcagcaattccttaacggcctcctgcggaattttcgtattatatggatttaatcctgagaactgttccccgtttccatcaaaaatatatatggagtttcccatatcttcatccaaatacgatgaatagcatcgattcaattcatccgcgtctatattcatgcagatatatcctttttgctcaccggaaattggggaacgatagcagtaaacacaggcaagtgtattctcatttttacattcctggaaattcatggattttctgttttgcacaatttcccacttataattccattcagaatcaataaaataatcatcccattcctgccgttctttggagatattcattgtatactcagaaataaaatcggaagaccaaaatgtaaaaatagcacctttgttcgttaccaggacattgcttccatctataagcgtatagagcatcgcattgctcctcagcgttttcctaacctctttcagtcttcttgccgtatcatagctttcaacactccactttttaaattcctcctgacccagatctgaggtttcggcaaaaaaccactggatataatcatttgaatagatggcgatcattttttcaaccatcaaatccgtcattagaactatactgttggaaatttgtgtcagagcctctttgtctgtcctgagcagttctttttttacctgatttttaagcatatacatacttacggaataaacgatcataaatacagctaccacaatgatgctgtatgtaagaatcaattttgtctgcactctgtgaagcaggtgcttatgcctgttacttttcattttacccccatctgccctgtcagcgatcccaatcctctgccgctaattctatacttgtctctatatttgctcggtgtcattccggtatagcctttaaagctttttataaaatagcttttgtcattgtaaccgaccatttccagtattctgtcaattttataatcactgtttttcaggtaatcacatgctttttccattctcgcttccacaagatacttgctgaaattttttcccatgacctccggaaacaggcgcgaaaaataagaataacttaaattgaattctttggataaatgcatcaggttcaaatcggtcatctgcatattgtccgctatgtaggaagcgatcattccttttagacggttatcctcctcctgtctctgtgcctccagatattggttcctctcatccagtatttccttcaggccttcgatcagctcctgatagctgtacttctggtgaaacaatcccaaaacctgctcttcatcaatcataatatcagaaggagccttatatgttctgagtctttcctgatataaataaatcaaatgcataaagccgcccattatatctgcttttttgggcctgtcctgtacgatcatcctccacagatcctcggattcctctttgattctgcctatatcctccatctccagggctttcttgaactcctgaagaagattgctgaaataatcctttgaaaatctatattcttcttctctgtaatctgtaaattccaccgttgcataattcctggcttcctgttctttctcttccttctccccggcttccataatacggttcatgcatgacaatatatcttcaaattccatctcgggcttccataaaaattcatccgcatgatacctcagagaatctcttacatatttgaattcattgtgggcagtcagcataattacatgggttttgggatatctttgtttgatttccttcagaagggaaataccgtccatatccggcatattgatatccagcagaataatatccgggcagtttgcttcacaaaaatccagaatttccagagggtttctgaatgcccctattaattgatatccatgctcattccaattaatcacctttgaaaagccttccagcattaatggttcgtcatcaacaataattattttgtacataatacccctctttttctgccttcttaattataacattttaaatataccacacatctgtgtttcttttctattatctgcagtcattttgcacaatttttttgttcacaaaaagccggcccactaaggaccggcttttatataaatttatatagcaaaatcaaacagactgatctggttagattccggcagatcacccagcagcttcagatcatccatcaaatcaacaaccgtcttggaaaccttggtccgctgcctgaaatcatccttggaaaggaacggcccgtctttggccgcctccacaatggcatccgcagccttttcccccaaaccgtcgatactgttcagggacggcatgatcttgtcatccaccacctgaaaactccgtgactgagccgaaaagatatcgataggcacaaaatcaaagcctctggcgtacatctcctgcaccaccttcatatctctcgccgcatcctgttcttttttggaaagaacatcactccggcgtttataatcagccataaccgattccagatgcttctgcccctgacacatcagctcataggaaaaggcggaagcacggatactgaaaaacgcggcataataagccagaggataattcaccttacaataggcgatacgccaggccatcataacgtaagcagccgcatgggccttggggaacatatatttaatctttttacaggaccatatataccagtccggcacattggccgccagcatggcctcttccatttccggcttaaggcctttacctttacgcacgctctccattatggtgaaggcaaggctgctttccacgcccatctcaatcagatagagcatgatatcatcccttgtacagatagcggtggaaatggtcgccttcccttccttaatcagcgtctgggcatttcccagccaaacatccgtaccatgggccagacccgcgatacgcaccagatcggaaaaggatgtgggcttggtatcaagaagcatctgcatggcaaattccgtaccgaactccggtattcccagcgcccccagcagacagccatcaatttgttccggcgtaattcccagagcattggtattctggaacaaagacattacctgcggatcatccagcggaattgtggtgggatccacccctgtgagatcctgcagcatacggatcatggtaggatcatcgtgtcccagtatatccagcttcagcaggttatggtcaatggaatggtaatcgaaatgggtcgttaccgtatccgttgtcatatcattggccgggtgctgcaccggtgtaaaggaattgatctcttctccgagaggcagaacaatgataccgcccggatgctgtcccgtacttctgcggattccggtacagcctgttacaatccggttgatttcacaggttcttttcttggagcctctttcctcataataatttttcacatagccgaaggctgttttatcggccagcgtgcctatagtacctgcacggaaggtctgtcccgcgccgaaaattacctccgtatatttatgggccttactctggtattctccggaaaagttcaggtcgatatccggctccttatctcccttaaatcccaggaatgtttcaaaagggatatcaaaaccgtctttttccagcggttcaccgcataccggacaggttttatccggcatatcgcagccggccttgccggtataggcttttacatccggggaattaaaatcattataatggcatttcatacaataataatgcgggcttaatgcatttacttctgtgattcccgccatgaatgccacgagcgaggagcctacggaaccacgggagcctaccagatagccgtcctccactgatttccataccagcttctgggctatgatatacataaccgcaaatccattcgtgataatggagttcaattcttttttcagacgctcctccacgatagtcggcagttcttccccgtacatttcgtgggctttattgtaacaaatatccgtcagtgtcttatcgctgtccgggatgaccggcgcacacttatccggccgtacgggagagattgtttctatctgatccgcaatcaggttcgtgttggtaatcaccacctcttccgctttatcacttcccagatactggaattcctccagcatttcttctgtggtgcgaagatacagaggcgcctgatcatcagaatccttgaatcctttgcctgccatgataatccggcggtatacctcatcctccggatccaggaaatgcacatcacaggtggcgaccactggcttattatactgttctcccagagccacaatccgtttattcacttcctgaatatcttcgatggaatttatattccggatcttttcctcattgatcatgaatttattatttccggaaggctgtatttccagataatcataaaaattcactattctggctacatccgcatcgcttttttcgtccagcagggcccggtacagctccccggcctcacaggcactgcctagtatcagcccttccctgcatttctggaacaggctctttggcacgcggggcctcttcgcataataggtcaggtgggattccgatatcagtttatacagattcactctccccgtattgtttttagccagaataatagcatgataggtaggcagtttttttacaatatccggattggaatctcccagggcattcactttggcaagggtatccacatcatccttcagtagtttatctgacagcttgataaaaatctctgcggtagcctccgcatcatccacggcgcggtgatggttttccagggatattcccaggcttttgcacactgcgtccagcgtatgcttcgcctgatggggcagaaggaccctggcgattcccacggtatccacatatgtatagtcgaaaggaagctgctgcctttccgcattttccctgataaagctgatatcaaagctggcgttgtgggccacgagaacgcatccttcacagaattccaggaaccggggaaggacctcctctatcacaggggcttccataaccatatcatcattgatactggtgagcttttcgatttcaaagggaatcggcacctggggattcacaaaagtggaaaacctctctgtaatttccccatttatgaccttgaccgcccctatttcaataatcttatttttgataggggaaaaacctgtggtttcaatatcaaacaccacatagcttcccttaaggggctgtcctttcccattggtgactatttccttcaaatcgtccaccagataggcttccaccccataaatcactttgaaaaaatcatttttatcaggattgggatctccagcatcttttcttttgcctttttctgccttccacagatcatcgataagatggttggcatcgggaaacgactgtaccacgccatgatccgtgatggcaatcgcaggatgtccccactgataagccctcttcacgatatccttggcttccgacaccccgtccatatcgctcattttggtatggcagtgcagctccacccttttgcgcacgctgtgatccatacggctgtgtgtgaaatcgctgattttcttgacgcctacgatggagcctatggtcagttctccgtcgaatttgtcaatcatggtgattccttttatctttacaaaggcacccggcttgattccttcgcagatttccgctacctgttcgttttttgcgaacattttaatcgtcatggtgtcagaaaaatccgtcacatcaaaaatgaggatcgttctctcattcttaatttctcttttatcgagattcaggattttcccgcggatagccacctcaccgatttcacccatgatatcttcaatggcaatggcttcttcttcaaagtctctgccataaaggacatcgggattatcagaacgcttggcagacttgaaaaaatcgccgtctcccttgaactttccctttcctctgccaaagccgccggacttctttccggaaaaggtctttccttccagtccgggtcccttaagaactgttccggtattgggggccttgcccttaatcgtccccccgtcaaagggcgctccctgggcattcccatcctgtccgccttctgccctggcggcattctgcgctgctccggccagataagcctcataagcggtatccgccttcatggggtccgtctgtccgccgccttgggcggctgcagaaggcatctgctgatatccttctccgtcctgatcgccgccgtgcttggatcctacatagcgcgaagcgatctccgccactctgcgggctatgaaaatatcatcctcttccttgaaccttcctgtccgcgcctcccggtactccacaaatacattcacaggcaggccgcagcgttcaaaaaagaccttttccagaatcctcgtcaattcatcacttttggtcctggcgagcacagtatcctcaatgcaaagattcatgcgtccctcctccgggaatgaaatctccgcattcttaaacatactgtacatcaaatggctgtattcctgcagttccagcaggatgctttcccggtaaacctccagaagcttttccgggttatactgggaagaaagacgatatttttcatatattttaatagtgatattgcatccggagaaaagctgctttttgatctccttttccaccgtgaaaatatcttccttctgtatcaaacgatcgctggtcagataaatccgcacaaaatccttctgtttcgtagccgtgacccgttctatacaggtctgctcaaacaggcttttcagcttgctttccagttttaatccggggaatacctcaaaaaaagcctttgccatttatgcctcccaatgcagcagttcgtcgcggagtaccgaaaggagctcctcttccgggactttacgtataatctctccttttttaatcaaaagaccttctccaacgccgcctgcaattcctatatccgcttccctggcctctccgggcccatttaccgcacatcccataacagctaccttcacgccgtccaaagggatatccgccaccatggcctccacctgattggcaaggcctatcaaatcaatttttgtcctgccgcaggtagggcagctcaccacctcgataccgcccttgcggagtcccagagtgcgcagcagcagtttggccgtgcggacctcttccaccggatcccctgtcaaagatacacgtatggtatcaccgattccctcatagagtatgattcccaggcctatggacgatttaatattcccgctccacagggttcccgcttccgtaattcccacgtgcagaggataatccgttttctgcgccagtatttcatgagccttgatgcacatgaggacatcagaggatttgatgctgattaccaggttgtcataatccagatcctcgatcattttcaccttatccagggcgctctccacaatcccttccgccgtaacgccgccgtatttctccacaagctgccgttccagggatccgctgtttacgcctaccctgatgggaatatttctttccttcgccacgcttacaacagccgccacattttccttcccaccgatattgccgggattgatgcggattttatccgctccgttttccatggctgcaatggccattttataatcgaaatgaatatccgccacaagcgggatgtggatcctctttttgatctccctgatcgccttggccgcttccatattggggaccgtgctgcggataatatcacagccggcctcttccaggcggaggatctgagccacagtcgcctccacatcctcggttcttgtattggtcatggactgaatcagcaccggattcccgccgccgattaccctgtcgcctattttaacttctctggtatgttctctgtacataaacactctcctgctacttcttgataaggcccttttcgataagaaacgctttggccacttccttttcgtctttgccttccacttccacctgatagttcatattacgcatttcgtcatcggaaatctgcccggtaagcttttccaacgtatctgcaaggccgggatatttatcaagggtatccgtccgaacgacggttcctgcataataggtggcaaacaggctcttgtcatcctgcagcagcttcacatcggccgccgccagctgggcatcggtggtaaatgcattggtcacatcaatctccttatttgccatcgcctgatatttcagggcgatatccacatccaccgtccccttaaaattcattccgtaagcttcacagatcatgggatatccgtcttctctctccatatagtccggatttcctccgaaaatcagattttcagatgccgcagccaggtcactgaaggtctcaaggccataggtatccgccgcttcctttcttacagcaagcacataggaattctgaaagccgtacaatccgctccaggtaagccccatatcattatattccttctgcaggttctcatataacacatcggagtcatcttctttttcatgtttcagcaccgtcatccaggacgttcccgtatattcgggatacaaatcaaaatcacccttcagaagcgccggctggatatttgtggttccgccgccgattccctttgtgatttccacgggaaccccaagatcattttctatgagctgccccagaatctccgtgaggacatattgttccgtcatgggcttcgacgcgattttaataggttccttttcttttccacagccggccagagtacctatagcaagagctgctgttaaaaataatgccaatttccttttcatgttttttgtctcccttcctgcttcggttaataaagttccatacttactcattatctgtcggatatcagctttttcacgaaatccgtagccgggttcgccctgatttcttgcggcgtcccatcctggattatcttcccctcatccataacaacaatgcgggtgccaagacgcagcgcctcatcaatatcatgagtaacaaacacaattgtttccttttgctggcggtgtatcctgcctatttcctcctgaagcctgcggcgggtaatctcatccacggcgccgaaaggctcgtccatcagcatgatctccggagaattcatcaatgccctcgcgattccgacacgctgcttctgaccgcccgacagctcgtcgggatatcttctgcgcacctcttccggcagttccaccagagcgagcagctggctcactctttcccgtacagcctttttatcccgttttccgtataaatcggctacataagaaatatttttttctatagtcaggtgcgggaaaagtcctgtttcctgcacaacataacccagttttctgcgcagggcggtgagatccgtatccgccagatccttcccgttcaccaccacccggcccgcgtcaggcttcagcagcccgttcatcagcttcagagccgtggttttcccgcagccggaggtaccgatcagcattacgaattccccctgcccgatatccaggctgaaatgcttcagtacccccttgcttccataggaagcagttatatctgtcagtgaaataatactcatgcctgccgctcccttctgtctctcgctccttcactccagggaatcttcttctccagcagataaatcagcctgtcggatatcaacgccaccaaagctataaggatacttcctgcataggtcatggccgcattattggtggttatccctctgtaaatggcaacacccagaccgcctgccccgatataggaagcaattccgcttaaggaaatcgtcatcactaccatgcttctcacacccgccagaattaccggcaaagccaacggcagcttcacccggaacaggatctgcattctggtgctgcccatcccggacgcgacttccgtcaaaaagggctggatcgtattgattcccgtataggtattgcgcacaatgggcagaagcccataaatactcaatgcaataattgccgtcttattgccgattcccgtaaaagggatcagaaatcccagcatggaaatagacggtatggtataaagtacgtttataatattcataatgatctgcgcaggcttccggaattcactgatgagcaccccgataaccagtcccagaaaaagggatattgccacagaaatgcctgcaatacgtatatgctgcagaatcagttctccaaaaaaggaactccgttccgcgtaaagtctgaaaatttcctgtatcatacaattctgtctccaatcgtatctattataccctcattaattacatttggcaaaggtaaaatggaaccgtataaaatggaaccgccgtccggtattccgaacggcggctgctcttattccgctttcaattcaaactgtactgccctgtattctcccgaaacagaaggaatacagataccggcattcatcaatgcgctgccgcttaagcttcttccatcctccatacggtatcccgcgtcaggatccagccctttcagcttcatgaaaagaggcttgttattggcacgcgtgtgtgttaccacaagatttaccagaacctgctttttatcctccgatacgaaagcccatgccacgaattccttgccgtccccgggagcgttcagcctgtaataatctccccggtggatgagttcgtaatacttcttatagtcggaaacctgcttcctgacttcttctttttcttcctgaggaagggtattcagatccagctcatagccaaagcttcctgccatcgctaccacacctctggtatggaaaggggtgattcttcctgtctggtggttgggacaggccgacacatgggagcccacagccccaatcggatacaggaaagaggttccatactgaatctccagcctttccacggcatccgtatcatcgctgcaccaaatctgaggggaataataaagcatggcagcgtcaaatcttccgcctcctccgctgcagccttctatcatgagatccggaaatgccgcggtcagcctttccagaagctcatatacacccagcatacagcggtgatatacttctccctgtctctctgccggaagcgaagcgctgtatatatcgcacatactgcggttcatatcccacttcacataatcgattttagcattgctgaggatatcggacatccgttcaaacagataatccctcacctcccggcgggacatgtccagaacaagctggaatctgctccggttaggctttcttcccggaatctgaagcgcccagtcaggatgcgccctgtacagatcgctgtcctcagaaatcatttccggttcaaaccaaagcccgaatttcattcccatggcgttgattttttcggacaggctggaaagattgcccggcagcttgtccaggttcacaaaccagtcacccagaccggaacagtcgccgtcacgctttccgaaccagccatcatccagcaccagcatctcaattcccagttctgccgcctgaccggctatcttcaggattttttcttcattgaaatcaaagtatgtggcctcccagttattaatcaggatcggccttcttgcatatttatattttcctctgcagatatgctcactgataatcctgtggaatttatgagacagagcagtaaagcccctgtcggaatagctcataatcacctgaggtgtctcaaatacctcccccggtgcgagacggaaacagaaggattccggatggattcccataaatacacggctctgccccatctgatccacttcagcgcctgcgatgaagttgctgctgtatacaaaggtcattccataacaatcacccgcatcttccgttgtctgcggagtgcacagaatcagggaaggattgtgatgatggctggaggttcctctcttgcttccgattgatacggtcccgtggcaaagcggcgtgcgctcaacctggcgctccatggcatgtcttccatgaaaatggatcatttcccattctccaaaaggcatgtccaggcatacagaaagcatcttctccagagtaaccatcccctctgaggaattcttcagcacggcggcccgtgtgatcacatcttccttttcaaatacgccatatttcaacagcagctccaggccggtattctcatcccgcaaaaggatggaaagggagctgctgatttcctcttcatcatataccgcaggcattcccgtgatcttataagctccctttgttatctcatgggaaacatagcggaaatccgcagccatggtaccgtcaggattcactgcctcgatgcaggaggtacgataatcccccactccctgtgaaggaaattcctgcggctggatatccagggaaaacgtcctgtccccttccgcttcataaggatttcccgaaaagcccgcatccgttccccaaaggagataatccatcgtgcttccatccacccgcttcccataatacagatgctgtaaaatgttatatcttcccaccatcatctgataagtggtttccgctgtctgcagagtgaatattttagttgattcattaaaggtaattgccataaacaaggtctccttcccattgttttcactatctccatcatatgaaaaccttaacttcctgtcaatcctttcttgttagcttcatctgttcttttgttgcttttccgttcagagtaaaaagctgtttttcctttgtcctgcctcctgtattcagcacggtcacttccacagttatctcctctccatgaatcaattcccatggcacttctacaaaaaccgggcctttcgcctcataagaagcccctttccggatcaagagcttccgcatatccccgtctcgcagagcgagggctgcaggatttgggccgggcagtcccgaggccaaggccgccgccgtcacacctgccaaaaagccgacaaataagccttttcttttttccgctttttcctgtttttcagccatccttcttcgcaaaggcctccttttattaaaagtccattaaaaaaatcaagggaattgtccataccatcccggacaaggaattcatagaaatgaagatttcagaattgataaaaattattatagcacagtcttttccctgacggaaggccggtaattataaactttttatgaaaagctgtcaaaaaccgcaggacagcggctgtctcttacagcccgccatcctgcggttccactttttacatccggcggctcttccgccctttattctcttatgagaaggcagcggctcttcccttctgagccacggctatgtatgtctttccttcattcagctggatttcatttcctgcatcgtcaaaatatctggtagggccgtaatcggtcgttttctgccaggtgatgtggatgcatttgccctttgtaaaataatacccgtcttctgtggtatcaaagttataaaaagcaagatatccctttgcatccagggtcatccatttcgtattctgtacaataacatttgcaaaggctaactgctggccgtttgccgcatccttatgcgctttcccgtggatagtcttataatacagtccatctgccgcattgtaggtaaatccggtcttggtgtaagggaatacattggacagatttatctggttagctgtctgggcgcctgctccgtactgggccagagtgttcacgcctgctgagaaattaaaatgcttggggctgtaaaactccggacgcagagcaagggaatatcccagctgactgcatgcattggtaataccgcttccgctgatataagcattgtggggagctttcctgtcgctgcttctgaaaaaagcattcgctccgggcgcgcttcctccggtaccgtattcaaatgttcccgaaaggttgttgatatccggcatgctgatccgatcagccatataccacacaccgccgtaatgaaccaggataggatcccattctgtggcaatgggaatataataagcacggcagcttcttatatttcctatgcgggaaagcccctgccagtcatcaatgacggcaagctgacgggaaatatcgccttcctccatgatttcatacagtaccttggcatggctgattccgtaggacggctgagccgctttatcggtaggcatcattatggcaataggccgggaagccgcctgggcagccggaacccattcattcgtatatacgcttctcacataaccggcaggtccttcctccgcatgtaattccgccgccggtgcagctgctgtcatacagagcactgcagccagaactgccgataacgctttccacttttttttcttatttttttgtacatgtggaaatactgacttccatttcatattttctttacctccccttaatggtttgaagcctgtccttcaaaacaggtctaatctaatagtactcatttctctcctcttcgtcaactttccgaatgaatttatggtaaattttcgaaaatattaagatttaacccaaacttcgcacatgcccctgtcccctccggccattgctttcgggaccgtctcccggtttggatttccgcccctatgcgccagccgtgcaggatttcctgtaaggggcgtataaactcgccggtccttaggccgcgtattttgcggccttagtaccgctgcgtgtttatccgagcgagagcgtcccctgcaaggaatcctgcacggctggcgcataggggcggaaatccaaaccgggaggcggtcccgaaagcaatggccggaggggacaggggcatgtgcgaagtttgaggatttcatataagattccatctgacgttttacaaaaaaatccgcctgaaggcatcagctttttcccttgccatggaaaagcctgtgtcttcaggcagattcctgccttttccggccgtctgactcatcggaacagccgggatatatcgttaaacataacaaagaccatcaggaccattaataccacaaagcccgcaaaatgaaccattccttccttatccggaggcacaggttttccccgtattgcctcaatgataaggaatacaagacgtccgccgtccagcgcaggcagcggaaggaggttcataacccccaggttcacactgagcagcagggcgatattaatcatattcaggatcaccatccaaataccgtatggctccgcctgttccttcacctcgccgatcacctgggccacaccgatagggcctgaaatatcatccttgctggctttgccctgtatcagcatgccgagactcttaatagtcgccctcaggctgtatcggacctcataatagctgtatttgaagattcccgcattcctgcagtccacataatccccatagccgttaaagcccagcaggtagcgctcttcctcttcgtcatatttggggacaagggttacggtatgcttttctccgtcccgaaggaattccaccttcatcgtttctcccgcgcccacataggtgttcagccagatttcccgggccacataaatccgttccccgttcatcctggtgatcacatcccccggctgcatccccgcttcctgtgccggatagccgtcaatcaggccgttgataaccggcctgtcacttcctgcatatcccaccacaatcatggccagaatataagccaggataaagttaaaaaagggaccggcaaaaacagtggaaatcctggcccagacgctggcgttgggaaaagcaccctccgacggggttccattgtcattgtcaagcccgtcttccccttcaaacatacatgcgccgcctatgggcagaagacgcagcgaatattctgttcccccttttttgaaacggagcagcttgggccccatgcccacgctgaactccacaaccgtaatgccgttggcttttgccagaagaaaatgtcccagctcatgccctacgacgatcactccgaataccaggacaaataacacgatagtcaattgcttccattctcctttatatgttcgatatattcataagtttctgtctctgtctgcagaatctcattgacattaggattctcaattacacggtgatgattcatacatttttcaatcagctccggtatttccagaaatccgatggcatgatccaggaacatagccaccgctttctcgttggccgcattgaacacggtcggcatgctgcctccaagctttgccgccttcagtcccagatccaacccggaaaaggtatccctgtccggccgctcaaaggttatctgccccaatttgaaaaagtcaactctttcaccggccatgggccttctttcaggataaaaaagagcatactggatgggcagcttcatatccggcattcccaactgggcaatcaccgcgccatccttatattccaccatggaatgaatgatgctctgaggatgcaccagcacttcaatattgtccagatccacatcaaaaagccatccggcctccataacctccagggccttattcacaaggctggcagaatccacggtaatctttctccccatggaccagttgggatgcttcagggcatcctcagcccgcattcctgccagttcctctcttttctttccccgaaaagggccgcctgatgcggtgagccagattttggaaacaccggaatgatcttccccgttcatagactggaaaatggcactgtgctcgctgtctacaggcagaatgggcacgccgtgttttttcgccaggggcattatgagatgccccgccgttaccagcgtttccttgttagccagggcaattgtttttccgctttcaatagcagctatggtaggacggattccaatcatccccacgacagccgtcaccagtatttcatagccttccatctccgccagttccaaaaggccatccatcccatgcagcaccctgacgggaagatccgccacacgtaccttcagttccccggccgccgcttcgctccacataacagccagcttcggcataaattccctaatctgcttttccatcagaacagcattgctgccggcagccagccccgccacctgtaaatccggattttcccggacgatttccagtgtctgggttccgatggatcctgttgaaccaagaattgctatttttttcatccgtatgctccttttagtcaaatcgtatcaaaagtatggcaagataataaatgataggcgccgtaaacagaacgctgtcaaaacggtccataattccgccgtgtccgggaatcagctttccataatccttgatattatggtttcttttgattcctgaagccgccagatcccccacctgggaaatcacagcgcccgccgcacagattacagcagctatccaggttatattctgatccgcaaataccctttccagaaccagccatccgaaaagagcacctaccagaccggcgcccacaacgccaccgacagcgccttctatcgatttcttcgggctcagtaccggcgccagcttatgctttccgattgccattcccgaaagataggcacaggtatcgcagatccaggagctgatgaaaatcatccaaaccatatagataccattgggaagatttctagtgaggaaaataaacgtaaacaaaaccggggcataaaaggcgcagaaaaatgtggtcatgacctgctccgctctgaatttagggaaggaaaacacataaacaaacatcagccccagaaaaatcacagcgagcattcccatccagtagacaggatccttaatgccatatactaccaggtagtacaggattattcccccataccccactccctccagggcattgttcttttgtcccgcatcaataaccccgcaggcctttgtcagttcccggaatgcaattaaagacagtatcagcatccccagagcaagaattcctcccccggtcaggagcaggaaaagcgccagaaccacaagcacgacactgctcatcaatcttttaccaaacatattcatcctccataattgaatacaggacagtccttttgtctcattcgtcttttaccagcccgtatcttctgtctctatgattatatgcttcgacagctttgaccaattcttcttttgtaaaatccggccacggaacaggtgaaatataaaattccgtataagccagctgccacagcaggaaattggaaagccgctgctcgctgcaggtacggatgagcagatccggatccggaatccctgccgtatccagggcattgctgatatcatcttccgttatggaatccggatccagctgtccctgcgcagctttggcagccagtcgcccaaaggctctgcgcagctcatcccggccgccgtaatttaaggcgatctggaaatgaagtccggtattatccttcgtagcctcctcaagctggtcaatccgtgtgcggatatcttcgtcaagaccgctcttgtcgccgataacccgcacgcacatattattctttgcagctgtttttaaacaggttttcatataattacgcagaagcttcatcaaagcatccacttcatccgcaggacgtttccagttttccgtggaaaatgcatacacggtaaggtattggattcccatgcggtatgcttcctcacagataacctccaccgttttggctccctgtacatgcccgtaattcctgggcatgccctttgcttttgcccacctgccgttcccatccaatataattgcaacatgattcggtacgttcatattcctattctcctgtccgcagcttctatattatccgcaggcaaagatacagtactccgtcttcacctgcacgtttttcccgaaaccgggaaaaagggacaagcacaaagtaacgcctgccccctctttattctcataattattaacctgtgctttattatttactcaataaaatttacacagtaagaatttccttggatttttcttcaaccagcttatcgatgtcttttacatatttgtcagtaagcttctgaagggaactctccagttccttgatttcgtcctcggaaacgtcttctttagccagcttcttaaagtagtcgttaccatccctgcggatattgcggacagcgaccttgccttcttcgcctttcttcttcacttccttaaccagttcttttctgcgctcctctgtgagctccggaatcaccagacggataacattgccgtcgttggaaggcgtgattcccacatcggaagccataatagccttctcgatttccttaatcagggacttttcccagggagagatctgaatcattctgggttcaggaaccgtaatatttcctacctgctgaataggtgtgggtgttccataataattcactttaagcttgtccaggatgtggggattcgcgcgtcccgcacggatagtggcaaaatctgcagccagaaaatcgtaagcctttgtcattttggtatcgaactgctgtaatttttcgttcatcgaaatttcctccctgattcttatttaaacggtaaccttggttccgttaaattttccgtttacagtattcacgatactgttttcttcattgagtccgaaaacccacatgggcattttattatccctggcaagtatggaagcggtcatatccactacctggagattcttctcaatcacttcatctatgctgacttctgtgtatttctctgccttcgggttcgtcctcgggtcatcattgtatactccgtcgatagccttggccagcagaatcacctctgcttccacctctatggccctgagcaccacgccggtatccgtagaaaaatacggatggcccgtgcctcctgcaaaaaagaccaccattcccttttcaaagtacttgttagccctgtccttggaaaaaagcttggtaaatgtaccgcattcgaacggtgtgagcaccgccgtctgcatcccctccgccctgcatatctcagatacatagatgcagttcattatggttgccagcatgcctatctgatccgccttcgtccggtctatgttctcactggtgcgtcctctccagaaattaccgcctccgataaccacgcctacctgtatgttattctccgtcagctgtttaatctgaagggccacctttcttacagtgccttcatcaaaaccggtcttcttttctcccgcaagggcttcaccgcttaatttaagtaaaattcttttcatcattaacctctcattctgcccggagctcattgcagttctttcgctttttgttcaaattccttcctcgccatacggaaacaatccatcagcttggggttaaactgcccgcattccccatcgagtatcatctgataggcaacatcgtaagaaaatgccggcttgtatacacgatcgctcaccagggcgtcatatacatccgctatcgaaaccacctgggccgcaagcggtatttcatcctctttaagtccctgaggataccctttgccgtcccatttttcatgatggctcaaagcaatattatagcagtattccttgaatatcatgttatccgtcacaaagatttccctgataatttccgcccccttggaggtatgggtcttcatcagttcaaattcttcccgggtcagcttccccggctttagcagaatagaatccggtaccgttatcttccccacatcatgcatggtggatgcatgggaaataatatcggccatatcctctgtcaccccgtattccggatagtatttaatcacatatttcaaaagtatggctgtgaaagaacggactctgtaaatatggttcccggactccatgctccggaactccacgatggttcccaacgtatcgatgatatggtaattcatctccgtcagttccctgttcttttccttgatttcctccgtctgcttctccaccatcgcttccaggttattcttatgatggtacagatctaccagattgctcacacgccttcttacaatgggtacttcaaaaggtttggatacaatatcggacactcccagatcatatcctctttttctggattcactggaggtgtcactggtaatcagtatcaccggaacagacatcatgagatgctgttcatgcatataatccagaactccgaaaccgtccatctccggcatgacaatatccagcaatattgcggctagcttaccacggttgctgtttatatattctactgcctccctgccattttccgccaggattacctcataatcctcttcgaagatacctttaagtatctcccggttcatctccatgtcatcaacaacaagtatcctatctttcacgtctctatacctttcccacagacgcccctctaccctagagccgactaatcttctgtatcagcattttataaatatcttcagcatccctcattgactcttccagatgatcaagattcttgtttctcagctgttccgtcaatacagaaatcgtctggtagaaagcctccagtcccaggtttccggaaagaccttttaatgtatgagcattcttgaaagcctcctcatactgtccgcctgcaatattttccttcatctgtgcgaaattgggatcttccggaaaacgcttcaggaacttcagatacagaccttcattgttcatgaaacgctccatggttctgtccaaatccacaccagcctcaaggagcagttttttattttcttcgttcatgttttcccctttaattcaagcctttccaagcagactttcctataatttcacgataaacaaattatagcattctttccgggtattatgcaatctattttttccatgtatagggtacgaacaggagcagcatcgggaatatttccaaccgccctgcaagcatgtcaaacatcagcacatatttggaaaaccctgagaaaaaggcgaaatccccgctcggccccaccaatgacagcccggggccgatgttgttcagcgccgatattaccgccgtaacattggtagtaaaatcaaagttgtcgatggaaaggagaagtatggataacgccagaattcccgcataggaaatcaggaaaatattcgccgctctcaccaccggatgatccagcttctttccatcaatcaaaaccacctttacacttctcggatgtatcaggatagccagctctttcttaattgttttcatatacatcagtattctggaaaccttaattcctccgccggtactgcccgcacaggcccctataaacataaggaaaaccagcagtgtcctggaaaactccggccatttgtcaaaatctgccgtagcaaacccggtggttgtcatgattgacgccacctgaaaagccgcatgtctcaggctgtcacccacattaccgatctgagaaaggatattaatggtaatcaaaagagtggcggccgcaaaaattccaaagtaaagctttacttcttccatgcagaaggcatccttcagctttcttgctataatcagataataaaaagcaaaattcgtgccgaacagcatcatgaaaatggtaaccacaacctgcacataagggctgtaacccgctatgctgtccgaacggatgccgaaaccgccggtaccggccgtaccaaatgccgtacataccgcatcgaacaggggcagcctgcccagcagaagcagtatgatctccagcaccgtaagcattacataaatcccatacaggaaaaatgcggtggttcttatcctgggtaccagcttgctcacagaaggccccggactttccgcacgcatcagatgcatggtctgaccgctggtcatgggcataatctgcagcacgaataccagtacccccattcctccaatccagtgggaaaagcttctccagatcagaatgccgttggaaagatcctccacccggggcagaatactcgctccggtagtggtaaaaccggatataatctcgaacagggaatcggtaaagctggggatttctcctgtaaaataaaaaggcagcgctcccaccaggctcatgacaatccagcccaatgcaacccctacatatccttctctcgcataaaactgaaagttttcaggccttttgaaggaaagtgctgtcccgaggacaagggacagcagcgcacatgccagaaaaaccggccatgtcctttccctgtaaagaagagacactgccagcggaagggccagaaaaaccccttccaccttaagaatccagccaagtatataagttatacatttgtaattcatggtacttatgctccttctaggcaagtatatcttctatatcatccaatcctttgtgagtggtgactacaataaccgtatctcctgcttttatggaatcctgtccggtgggcagaataagcttcccccgtctgacaatgttgcacagaagcagattgcttttcagcttcaaatcggaaagagggacattgagaaccttggaatccttttttacaaagaattccagcgcctccaccttattgtctatcagcttgtataccgcttccaccgcacttcccatggaattctgcataccgcggacatacttgataatgtgctctgccgtaaggtacttggggctgataacgcttcctatatcaaaattatctataataccgccgtaattgatcttgtttattttagtgataaccttggccttggacacctttcccacatagcaggaaagcatcacattctcctcatccaggcctgtcagtgatataaacgcatccgaactctcaattccttcctcacggagaagatccgtaccggaagcatccccgtatatgatcatcgccttgggaagaagttcactgagttcatcacatctggcacggttattttcaattattttcacctgtattttggactccaggagcattctggcgagataataggcaagcgttcctcctcccgctatcatcacatccctgatcattttgctctctattccaatactggagaacagcgccttcattttgtccggaggcacgatgacagaaatataatccccctcatggagaatggtatttccatccggaataataacctcatggcttccgtccttctccaccacgcaaatcagcatgttgaatccgaaacgcttcgtcgcttcactgattttgcgttccgaccaggaggaaccatcagggatccggaatctgaccagatcaacctttcccttggcaaaggcatccacatccatagcggaagggatccgtatcagcctggctatatcagaagctgccgcgagctccggattaatggccagagaaaggcccagttcttccttaataaaccctatttcggcataatagccagggtcacgcaccctggcaattgtctgacagtgtcccgcctttcttgcaatcaggcagcacaatagattcacttcatctttccccgtaaccgcgatcaggaggtccgcttcttttactcccgcctccacctgaacacgatagctggtggcattgccctggatgcacataacatccagcacattgcccaccagccccgctttctcctcattcgtgtcaataatggtcagttcatgaccttcttcattcagctgttcggccagggcatatcccactttgccgcaaccggcaattatgattttcatttgtgtttcctcagtgcacgcagcactttaccttaattttcttctttttttgctccatgtggcatacgccgcttaatctgtccgatatctatacgcgtcctaacgcggaaagataatacttgtacagagttttgctcgtccccttgctgtaatggagtccgtccgtcaaagtataacccgttccctgaagataggaaaagctgtctatccaatgaatctgagggctgagacgggcctgcagcttcttattaaaggtgttcaccatggatttggttatatactgcccattttccacaggattaacagacgcataataaacagtcgcacccttttgtgtccactccgctgcttttttgttaaccagttctgcgtaagcattcacattggccacatcattcacgcccagatttatgaggatcttcgtgcctctgcccacaactgcgtcaatctggggcaccgcttccgatgcaaaccatttatagccctgggaagatttggcaatccatacataatcgcttccgcctaccgcattgtgcatctgcacaaacctggagtcacctacgaatataatttccggtccttccgcaagttcttcctctgctgtcattaaatccgcaaatgcctgcagctgggtatctgtctgggcaatctgttcaagctgtacctgctcaagcgtctgaagctggcctaaaagctggagctgcgccgcatcgataacagcggtctcctgcagttgagtaagtgtccggatctgtgtctgaacctgctcaagctgggtctgctgaatatcccggatgctctgaagctgtaaaacaaagccttctgaatcctcttccggaacggttgtcagagtaacagccgccgtatcctgtggctgctctgtgcccggtgcttcttcctgcactgccgccagggctgtctgtgtaacttctccggcttcagccgtcttttctgcccgtattgtcatagacggtactgtcagcgcacacaccgccgcgaaagcaagcgctgtatgaaacagcctcctattcactcttttcgtcatctttaagtcctttctgcgaaaacaagtcttcatcaaccaagcaaccctattatacgttgactttcgtgaaaaggcaatcctttcctgcgataattgacagaaaagcggctgcaaaaacggaaagaaatttacacaaaatgcgcttttctttccgtttctttacatagcttttactttttacttatctttttatctgtttgttttaatgaaaacctgcatttcgccttcgcctctgttggcccatgcataataaggaatccactgcagaagcacgtcttcatataccggctttttgtattcccggtacagttctccgtcttcctccgcctgcggcaccagttttttccctttcgtggttattgtcaccatacgctgtccgattttctcttcctgtacagcctgaggaacgggatcctccgcaagagaatacagctgaagattcttgccgttatccgcttcttccatgcagtaaacgatggggcctcttgtaacggctgctttgccgatatcttctcttaccctggcatccgcctgcatcaggcgcacttccatggggaagtcaagctccagcttttctccgccattccacactctgtcgataatgaggtagccatcctttacctgtctggtttccccgtctgcggtcaccgtctcgccttcttccagtcccttctgtccattcagcgtataggaggaacaccatccggggatacggaatgcaagcctgcaggcaaccggttcttccgcattgatttctgccataacctttccgtcccaggggaaatcggatgaaatacggatatccagctttttgccgccgcagtctttttccaggacgcttcccatgtacagatgtacataaagggcatcctccgcttccgtataggcgtaagaagcgatagaactcagcagtctggcaatattaggcgggcagcatgcacaaccgaaccatttctggcgaaccggcttcacatggaatttacgctcatccttatggcaggcctcaggcagggattccagcggattcacatagaaaaagcttttcccgtccagagccataccgcttaaaataccgttatacagcgccttttccatcacatccgcatatttactgctggccttgatttccagcatccttcttgcgaaaaatacaagcccgatggacgcgcaggtttccgcataagcactatcattggggagatcatagttaaaggaaaatgcttctcccatatgggtagcaccgataccgccggtaatatacattttcttttgtgtaatattgtcccaaagcttttcacaggcttccaataacgcctcatctccggtcagacgggccacgtccgccataccggaatacagatagaccgcgcgtaccgcatgtccgacagcctcgtcctgttcccttaccggaagatgtgcctgattataggaataacgctgctcatcctcatgtccttttttcacggcttcgggatgctccgtatcataatagtagggtttggttcctctctgatcaacgaaaaaccggctcagattcaggtatttatcctcacctgtcacctcataaaggcggacaagagccatttcagctatttcatgaccgggatagccttttaattttccttcttcctctccgaaacgggaggcaacaaagtccgcatacttttccgcggccttcagcagcttatccttacctgtagcctggtagtaagccaccgctccctcggtcagatgaccgaagcagtaaagctcatggttatcacgcaggttggtgaatatcatggactggtcattgatgatgtaataggtatccagatatccattatcctgctgtgcggcacatacgatatcgatggcttcgtcagccgttttttcaagctccggatccgcatgctgggtaagggaatagcccacggcctcgatccatttggaaaaatcgctgtcctggaacaggcagccgtaaaaacggtcttccaaatgatccatatcctccggcagcggctggaaaatcaggggccatttcacttctttatatgcatccccctgttttcttttctcttccgtaattttacctgcaattttgaaattgcgcatgctgaagcttggctccgcatcgggaagccggtcgttcagggcttcccactgataggggataacctccttgcggaccagttccatttcttttttccagaaggcatctgttacctgtacctgtctcaaagataccggtctgctctgctctttcttatccatatttcctccatcctctctgtccggacgcattcctttgccgtctgctctttggttccgcctgtgccgcccctgcctttagcgcccggtctttcttcgcggccggctgctctgcaaggttcctgtgcaggcacgctctcgctcggataaacacgcagcggtactaaggctgcaaaggacgcagcctaaggaccggcgagtttatacggcctttactggaatccttgcagagcagccggccgcgaagaaagaccgggcgctaaaggcaggggcggcacaggcggaaccaaagagcagacggcaaaggaatgctgggatcttatcttttattcatttgtatagtaacagggatcgggagggttttccattgctaatatggaaaggagcatgtataatatggaaaaagcagaaattgtgtgtggaggtttttttatgggggtattgcttaagctgatggaggagcggagaatcagtactgctaactatattacttttgttaatccggcgcctcatcctgacaggattatgtctgaacatgattttctttatatgattgatgggagctggcggatacgggaggaggatgaggcttttgagatgcattcggatgatcttttgattcttcctgcggggaggcatcattatggggacgggctcagtacgcctcataataagcacatgtatattcatgtaattcctttggggagtgaacgggcggcgaatgtgaatggttccggctttgaggaaggtgagccgggatgtttggcggcggctgagccggctgaggagtttgcagagttccattctttgatacattgtcagagcaatcctcatattaaggagctttttcaggagattattgcggagtgctgggctgtttcttcttttcgggagcagaagctttctcttttattgaatctgcttatgcttgagctgaaggagcagcaggagaagccttattgttcttcctccaatagtatattggaagaggcttcccggctgattcagactacgcctcagactttttttacaggaaaagaactggcggaaagattttatgtgtgcgagcgcactctttccaaccagttcaaaaaagtttatgggaaaacgctttatgcttatcagatggatgtgaagctggaaatggtccggcagtttcttttaagccagccggaggtgaagcttcatgaaacggctctgaatttcggcttctgtgatgaattccatctcagcaggacgtttaagaaaaaatatggggtgtcccccagcagataccgggaaatcagcgtggattaggcggcattttttccagcagctgtaccaggttatagagggaatggactaccgccaggggctgtatcgtatgcttcctgtcctgcgtgtgggttctccttctgtcgattaatatggaagggataccggctgatgccggcccttccacatcctcatgataggaatttcctatgtaaatggtattctcagcttcacagccgcagctgcaaagcattttttgatagaaacgtctgtcgggcttatatattttcaaatcttctgaggaataaattccatcaggctccattccgtttctccggatattcagcagcaaaggctccgtgtcggaatcggccccgatgatgacccggtattttttcttaagctggttcaccgcatctgccgctccttcaaaagccttgctcactcccaacgctgtctgcataaaatccgcatctttgtttctgtttcctgtgattccatagcgggaatacaatacagacagatccttcctgaagatttccgcttctgtcagataaccgtttccattggcttcttccttatgctgtctgtgtaaaatcttccattcctcacagaacaattcaggattcactccgcattccgttagttccggaatcctccgtaccgcttcccgataaccggcgccggcggcaatcaatgtaccataggcatcaaaaataatcagctttttcatgacagctcctgtaaccatgcagtcttttggcttatatcaggcctttcagttcgggcagcttatcatcccttaagaataccgggatcacatccagcgcggcctgtacctgaattgtctgtcctccttcataaacgctgccgtcatggacagaagtccatttggcgccttccggaagataaacctctctttcataagaatcctcatataaaacgggagctaccagcatatcgctgccgtacatatactgctctttcatatcccagcagcatttctgttcggggaattcatagaacatcggtctcattaccggacgtcccagcatatgggcttcttccatgagttttctggtataaggtctcatggcttcccggaattggatatattttacaagggtggtgcagttctcttcgccaaaactccatacttcattgtccgcacctgtgggctgcatgatctctcctgctttattaaccactgtttcggaaggggtacgatcgccatgcagacgcattaccggacagaaggtcccccattcaaaccagcggacaagcagtctgcggaaggcttcgtcctccgggttaccgccggaaaagccgccgatatccgtggtccaccagggaattcctgcgattcccatgttcaggcctgcgcatacctgtctgcggaaggtctgccagtcggaatgaatgtcgccggaccatacaagggcgccgtaacgctggcttcccgcccatgcgcagcgcagcaggttcaccacattttcctgccccgcctccgtctgtccttcatagaaggttctggcataggcctgaggataaatattgccgatctgggcgttggttccctggtagtaccggtaattatcaaaatcatatccgctgtattccggctccgcttcatcaagccagaataccttaattccgtaatcataataatttttcttacatttttcccatacataggaacgggaacggggattcgtggcatcatagaaggtgctgtttccattataaagcatggcgatatccacgcccttttccgccttcaccagcaggcccttctgtttcatttcctcatagttttcactcttccagtcaatctggggccagatggaaaccatgagttcgattcccatgtccttcagttccttcaccatcgcttccggatccgggaaaaattcttcatcaaaccggaaatcgcccatcttgggccaatggaagaagtcacatacaatgacatcgataggaatctttctttccttatactctctcgccaccttcagcagctgttcctggttccagtaacgcagcttgcactgccagaagcccatgccatattcaggcatcatgggaaccttgcccgtagcatcgccataggcctgttctatttcatccggggtatctccggccgtgatccagtaatccatctgtttggtgctttcggcataccattccgtggtgttggaagcgaagctcacgcggccgaccgccgggttgtgccagaggaagccatagccctgatcggaaaggacaaagggaacactggcctgggaattcctgtgggccagttccagattacagttcttcacattcaggatatcctgctgatactgtcccatgccgaacagcttttcagccggttccgaggcaaaggtaaccgtcagatggaaatccccgcctatgatgggcttgaagaaacggtttcttttattcagtgcgccgccttctcccgcctctttcaggagcagttttccattctggttgtaaaaagagatgtcacattttttggaccatccgctaacctccagcaccgccgtaattttgccgtttgttatgactcccttgtattcctccaccttgatttcggctttcaccggttcctggggaaggagggcataatccgtatcctccagttctcccaacacagtggaacgcacacggaagctgttggctccccagggttctacggaaagcacttccccgtcccagcggtaaaccagtgcatttccttcctgactcatcgtatacataagcaaatcctcctatacaaaaaaatggcaaaccggcttgtccggttccgcctcctttgaggctggaacacacggttcacctgtctgccatcattatattcattcttttcggatgattcattatatattttgaccgtttttttaagtatcctgaccttttctgtatttctgcggagttgtgtgataaagctttccaaactccgtggtaaaataatttccgcttccgaatcctacatccagcgcgatctttcccaccgggtcatccgtttccctcagaagccgttccgctttctgtagcctgactctctgcacatactccacaaaggtcatatggaaattatctttaaaaaaacggcagagatagccttcgctcacggacagatacgccgcaagggagttcagcacaatacgctgggtatggttttcttccacaaaacctacgatttttcttatcatctcactttttctcgtatttgtttttaccggcttgatttcccccttctgcagcatgagaatatcataaaccacctgaagaaggtatgcacggactaggacttcatagcccttttccttttcatcaaatacaaaaaatgttttattgagcatctcaaacaaagctttctgtatagaatttttttcacgcagaagtatgaaatgtccctgttcctctgaaaaaagaggattcagatacttctgttcaatccggtcatttgccatgccggaaagaaagctgtaatcaaataccaccgccctgaactccagctgagtgccgaagcagtcatgggaaccatgcagcgcgttaggctttatgagaagcacatctccctcttcaataataaagggttccgcctccacctgaaaattagcctttccggaggtaataaaaaaaatttcaatttccggatgccaatgatagctcagaggcatctcaaaatcttgttccattttagtttcgtaggcgctcaccggaaaaagcaaatccccatgctgcctgttttcccgtaacggtctggatatcttcatgtttttctctacttgtagtcctccacgtcaaattcacggtctttaaaataatactttctgtcttcctcagtaattttacgcagaacccggcagggatttcccacggctatcacatcatccggcaaatccttggtaaccacgcttcctgcaccaatcaccacattattgccaatggttacgccgggattgatcaccgtattcccgcccagccatacattgtctccgatagtgacgccgataccgtactcatagccggtgttcctggaatccggatgcaccggatgacctgccgtataaatagatacattcggggcaatctgtgcatttttcccgatcaccacttttcccacatccagtattgtgagattgtaattggcaaaaaagttttctcccacttctatgttccagccataatcacaatgaaagggggtctctatccagatattttccccgcattttcctatgatttcctttatcagtgccgcctgttcttccccctgttccggggacaggctgttatagcggtatatccttttcttattttccatcctctcctctgagaggccgtccagccacgccttatagggcagccctgcaagcattcgttccttctgattcattccattcctcatttccgcagcgcatcccctttttctgcccatgggataatgccgcttatttctgcctttatacctgcgaaggagtattcggctccgttctttcttccataagctgcagcatccgattctgtgcaaggcatatcatccctgtttcatagtcctcctccagacaggaagagacctccacctgcacccggaattttccggaaaggcgtctgcacacatactgctccaatctttccgccattccatccgtcagaaaatctccatacaggacaaaacgggaaggggccacgatacaggcaaatgtcgtcagcagggcttccagctggcataaaacctggttttccttataataatccagttcttcccagggaacaggaacgtaaacatcccccatctctcccgcgaaatgggaattcccgtagtaaatacttccatccagaatcagtcctgctcccggcagaaaggagcgaggaaaataaatccctaccagggaagtaacatccataccgcaatgcttcctgtaatagccataggccatggcattgatatcattctcaaacaggacgggaactccgtacttttcccggatgcggggcaggaaatccagtccctccagcccggagaaatcatttatggttactacatcatcaatggcttccccgggcagtccgaaagcgataagcccgatattgccaaaaccggcaaaaacttcatcaagacagccgtcaaagctttctgcaccgatttcttccatatacccctgacgttcccacagcttctgccctttcagatccacaacaagcgtatgaatataattcctgccctccagctgatgcccatagataatcaccatagtccggtatccgtaacaatagccgtactgcatggaaggacggcctccgccggagggtaccattcccagttcctgaacctcaccctgctcaagcatttcggtaatcagcgcattaactgtcacaacacttaaccccgtcagcctggaaagctgcggctttgttgccttcccttccccggataaaacacggcgcagagtgctaatattcaattgtttcatcagcctggtatccgctttcatcctgtcactcccggtaatatctggtgaacctcctgccgcttacgaaagaaactttataaaggttatttataatgtaatggaaaatgaatgatttgtcaatctcagaatatcctgtgcattttaagaagataatccagcagggagagactcttttcttccttttggtctccgccggttcctccggggataacggaaggctttgttttcccgtggaaatcgctccccattgtttccagcattcccagttcctccgccagcttatggaaccactccacgtcctcttttttatgataactgctgtaaacctccaggcctgccgcacccttttctttcatggcgctgattctttccctgctgcggcccaccgtattgatcggatgggcgattacagaaattccccctgtatccgcaatcagcttctgcgcttcttcaaagggaggataggacaccggcagataagccgtttttccctgggagcaataatcccagaaaaaattcacatagggattatccgatcgttccccgccctctctgtaaggagccaggagaggattttctgaatttctgtcatccgccagagccgcctccgcaattgtttcccctaccacaaccccatcacgggacatggccagaaccttttcctcctcaaaaaaaatccctgtgtctttgagaattttcataacctcggacgaatttttctttttctgtgacagaatatcttcttccagctccctgtatctgggatcctgaaaatcgatcccatatcccagcaggtgcagatccactccctcaaaaatacagtcaagctctacagcaggaatttcccggatcccaaaacgggaacaggccgtcatcatccgttccacccctctgaccgaattgtggtcggaaagagcaactaccttaagcccgctgtcgtgacatatttccgccagcctttccggagaaaactctccgtccaggctgatctgtgaatgcatgtgcaaatccagccagctcataggctgcccctcttctgcctgtccagcaattcctgcagcgcttcatcgctgtcttcgatccaaacgtcttcctcctccgcattcaggcccagatattcccgtaaggagcagggctcatcgctgttattccatgtgtccacgtaatcgtcaatttcttcaaaggttatttctccgtccaggtaacgttctttaaattttttctccatctcttcctctctctgttctttaattttgctttactgcaacaaaggtcaccacctgtgtgacaagttccacggggccatattcccggggtatctggtatttatgctgttttactgtttccttacgaatcccgaatccgctgaaaacacggtgcagataccgctgcatctcttccgtcttcaggttcacttcaaactgcggttctctgtaacagcccgcattttggtcgaattccgtcatctgcgaatttattatcaggcatacgatcccgttatctttaaggccgcgtttgatttctttcagtttattgacaaaggccgcctccgattcggcatgttccagaacggagaccgcaataatgaaatcgaaggtatcctcttgtatcagataatcctccaaaggcataagcacgccggttatgttcttttccagaccatattttctgcagttttccttcagtttgtctatcgccacatccagaatatccaccgcctctgccctgcatttatcccggaagtgacagacaaagggaatgcagcttcttcctactccgcatcccagatcaaggatattgatttccgtataattatcaaaatacggatatagatccgtaatcgttttgatcggcttttgcagccaggagccttcccggaatagttctgcgctttcatactgtgcgatatgagacaggcgctccgcctctcttattgtctccagcgctgatttttccgggacggccttcgctttattatctatcatcagaaaaactgtacctctatctgtttaaaatccggtgcctggttattagtataactgactgctgcagtgcctgtcaaacaagagcgcctatgcagggacttataccgactgtaacgatttctacggctgataatatcttttatatatctccacctggatttttttaatcatcgaccagatattgctgtcctgattggacagtactgtcagagtgatatcttccttcggataatataaaaattttgcggccactccgtcattgcttccatccttatagatgcagaaaggcatgtcctcttcctccagcaaatagaattcgaatccatatccatttttcttatataatccgggaatggacagccattccaccgtattggaaaactcacagtgagggctaagaagcatctccgcatattttttattcagaatgatgtgcttacggactgcatccagaaaaagattcagatctccggccgttgtgtaaacgcctccgtcaggagttcctaccggaggataacaataaatattttttttgtaccccttaaaccgcccttcttcatccaatatgcttttatagccctccgccgtgttttcgttaatcccgtccattgaaaaaaatccggttctgttcatacccgcacgctcgaaaatattgcgggtgaaatattccctgtaattaaggccgcttgctttttcaaccgccatgcccagcaggataaaggagcagttgcagtatctgacatttgtccctgctctgaaattcggctctttataggcaaaattcttcaaaaagtccctgcattcccgtatcgcataattggggctgtccacaaacagggccgaataatcttctccggcctcttcatccgcatcatccgctataccggaagtatggttcagcagatgctcaatcgtcacgtcttcagggattttagttccggataagtcaacgatatttactatcctgtcctcaagcctcagctttccttcctccacaagctgcaatactgctgccgccgtgaatattttggttatggacgccacgtcaaacctggtctccgtattattagggatccggaagggacggcttgcataaccatacgcttcgttaaagacagttattccttttcttttcagcatacacacgccgctgaaattatgattctgaacatattcttcgcaaatcttttcaagataatctttcatttttcattctctcttctgtttttatgctattctttttatcaaccgggctttctgcatacgaagccgaggcactgcggcaaagccgcacaaggatttttgtgccagtcatatttgtccggttcgtcatttttatctgacagataattatgatttggcaggtcttccgggatactgtgaaattcctccatcctcaggattgaaaaacctgagacagcaaaggcatttacatagtcctgaatgcgccagtcataagtaacatcatcaggaaacggtcctgtctcttcatagggcttccgtataacaaatttccccgcctccaaaccttctttatcaaacggcctgctccatggatgcgtatcaaacatgatataaatgccgcctttcttcaaaatacggctgaagtttttatacatggctgcaaaatcccggatccatacatgtacgccgttagaagtgtataccaaatcaaaaaaatcattgctcaactcattcagactcatgctgtcactatgtaaaaatttgatattataatttttaccttccgctctttttctcgcattctcaatctgtccgcaggagatatccgcagcaaaaacctccgctcccatttcgcaaaaagagaatgccgccacgcagtcaccacaggatgggacacatactttctttcccttcaaatccggaaaatattccgccagtaattctgccacagctttcgggaaccccctgcaaggatctttgcctatttccttaaaaatttcagcatagtcaagctttccgaagtgttcatcagaataactgtcccatgtctgttcaatttcgttatgttcctgcatataaagcctcctttttcggtttctgcctttcctatcgcaaacttctttctataccaggaaaaacttcttcttcgtccgtatctcttccttccagcggaagcaatcgtttaaatgcagcatgacatgacgggtaggcggcatcagcagcagaccggcaacatccttctttctccagaaatcaagcagccagaaggactcctcctgtctggttaccccgccctcattcaggatcctgtccaaatcatcaccggataccttgcgccgcatatcttccggagtgagactctgcaccagctcccttgtctgcctgcccacttcattacggtacttcagaagctcctgtatatccgcttctttgcttaacgccattatttcctcatcctgtaaggcattcccagtgtccgttatggatacgtgaagacgctttttccaatcttcattaaagatttgatttcttctcccaaccaatatattcatggtaagatcttcgatacgggcaatatgccataccacccagccaatcgtctcatccttggatttcggcataacggcatattcctgatccgttaaatcccggaataaaccgtccacttcattctcacttccgcctgccatttccgaaggaaacagcttctcatggatttccagaaataatttcttcgcttccgggagtttttccctgttacgtaaaatgcggtttaaatccttatgcttttcactaaggccttctccaaaatatttcatattcttctcccttttgccaatccagatacagatgcttccatgttaccatctgtatctgaaaacttcaataattacccagtcaaaagcagaaggaattcagaaactaaattcctgacttctaattcaaaaaaatatatcgttttggtatcagccttttttgatatgacagtagataaaagggtgtaaatgtggtactatacactaaaggaaggtgaagccatttggaattggatatcaacaatttgcgtaaaatatgtatacctgaaaatatagaaataaccatgcacgctgcgaggagattggagcaaaggggcatttccatcaatgatataattcactgtattatacatggagaaattattgagcaatatccgacagattatccgtatcccagttgtttgatactgggtatttccgtcaatgacaaattgatacatacagtcattggaagtaatcaatcacaactttggatagttacggcatattacccagacatcaataaatggagtgaagatttcagagtgcggaaggaggattgacatgaaatgttttttatgtaaaggtgatttagagaaatctactacaacttatatgaccgattacaataactgttatattattatcaagaatgtaccttgtacaaaatgtacccaatgcggtgaggtttatctgaatggtgttactgtccagaaaatcgaaactattattcaaaggcttaaggcggctttaacggaaattgccgttgtagattttacacaggcagcctaatggcaagacattggcgtggaaaaggctagttcattaagaactagcctttttacgttgtcctctgtgccgccattgaaaacgactgcaattatctacatcagaaaaaagggccaaccaaaaacatagattttatctttatattttgattttcgtccattttccggagcggaacctcaggcttgtgagaataaaccgaaccagctgatcggcgcagacaccaaaccagataccgatgattcccagtcctgccgtatagcataacaggtagctggcgatagggcgcacgatggttacgctgaccgtggacgctatggtagtataaatcacatcccccgcacctctcaggcagcccatataaataacctgcgctatctgcagcagcaccacgacaacaataacccgcatgatttccacgcccatggcgatgatctccggttcggaaaagaacagattatataagtatccgccgcaggtcagatataccacagccaggacagcggctatcatccgcccgatattctggcatatgcttccgtaggttttagccatatccacatttttggcccccaggctctgcccgatcagcgctacggccgccacctgcatgccgtccccgaaggagaaggacaggctcatgacattcattcccacctgatgggcggcaaatgccgcggttcccattttcgccgccatgaccgcaacggacaaaaatcccacccggacaagaagctgctccgcaaggacgctggcccccagcttgaccatactcttcccaacctccagggtggggcgtattttttctctccacatataagggaagctgataaaatcatttttacaggccgccacgatactcataatacagccgaccatactgccgattaccgtagcgatggccgctcccgatactcccagcgcagggaatccgaaatgcccttcaatcagcagatagttgaaaataacattgaccacatttgccgccacattggttttcatggcaatttttgtattgcctgcccctctctgtgcggcattcaccgtcagggaaattaccgtaaatataatgaatcccatgataattcggaaatactgtaccgcttccgtgtgggacgcttcctccgaaccgcacatgcggatgatcggatccgcaaatatcacacaggccagactgacaatcaccgacataatcaatacaaaaaaacaggccgcacacagaacctcattggctcctttctgatttttctggcccttacgccgtgctaccagcgccgagacggatacattcaccgcgataaaaacagccagtccgataaacttaggctgtgtagtcaggcctaccgccgccacggcatgggctcccaccctgctgaccatcagggaatccaccattcccaccaaggctacaaaaaatgattccagtacagacggccatgccatcttcagcaccgtctgtatgttttctctgctatactttttcatgtcctcccctttcaggcattttttactatcctgcctttcacttattttattgtacgttacatttccggggctgtccataagcgaaccgtcaattttgcagagtgtttttcggcaaaaagccgattgactggtgtttcccggcggattatgataagcagtggcataaaataagttttcaggaagggcttactcctatggaaaaaatacgctgcattataaaaaaagatcccgttcttatgatctcgggactgctggctgtcatctcggcattcttcattccgccggatgccgcctatctttcctatattgatttccatgtgctcgctcttttgtactgtctcatgtgtgtcatgaacggttttcaggaaatagggcttttccaaaagctggctgtttttatcctttcccggacaaaaaatacaaggcagctgacagccgtccttgtattcctgtgttttttcctgagtatgttcatcactaatgatgtatcactgatcacctttgttccctttacggtcctgatactgactattatcggacaaacaaagctgatgatatatgtaattgtcctgcagaccatcgccgccaatctgggcagtatgctgactcctgtgggaaatccccagaatctttatctgtacagcctttccggcatggatatttctctttttctgaaaaccatgctgccctataccctgctttccgggctgatgctcctactcgctcttttcttaaagccgggagaagaggtttcccttcaggctgttttcacggaaacgaaggctatggcacgcaggcctctggcagcttataccctgctttttcttctgtgccttggctgcgtactccgcctgattccttggcaggccgttcttcttatccttctcgctgtcctgcttttctttaaccgcagattattattaaaggctgacttcggccttctgtttacttttgtctttttcttcctgtttataggaaacatggggaggataccggcgattgtgggttttctccgctctgttttatccgggcatgagcttttcctgtccattgccgccagccaggttatcagcaacgtgcccgcggccattcttctttccggctttaccgggaattatctgccccttcttgccggcgtgaatatcggcggcctgggcacactcatcgcttcgcttgccagcctgatttcctacaaacagtatgccggaaccgccggctgccataagggacgctatatgctgtattttaccgtgatgaatctgatttttcttgcggctctcgccattcttgccgccctgcttttatagaggatgcttatctccgtgctgcagccgccatatatgtcatgcttccgccatgcttttcagtatggctgccgcctgtctgaaaaaggcctcctcacgaaggaaatcttcttttcccgcagtcatagtcagattgagaaccccttcctcccccagcgtagccgcaccgaaaagcctttttgcattggggacaaggggcggtgcaaagatgaattccttaagccggtaagcgccgtatacggatggaatcggcagctttcccagattggtcacgctgatgcctttgggatttccatgatagccgaacatatctctcaccatgcccgccgctttgttctcataaccggcatagccggaaaagtaagccgcgtctaccagcgaaggccggagttctcccataaaccggagaagaaaatatttgtccgattcccggttcagttttttataaatgagccggtgtaccctgcacgcattttcccagaaatccagggacggattgtaggcataggttatggaaattcccgtggcatagtttcccatcccctcatacccgtccgggcgcacgctggccgccaggcctatgcttcttttttctcctgaggcccgggctaaagctgtgacaagaaggctgttcagggtaacctgatgctcccgggcccttgtaagcagtctttcgcattcttctttaggaaaggtttccagtgaaatccggatatctctgttttcccaatatttccgatgcagttctccataatctgcccagccgaatacccgtccgctcttatcccagctgctgttaatccgcctcatcaggaacttcagaggcggcttcagctttccttttgcttcctgtccggggaaaggatacagctgtaagggacggtacgggatctcttttcccgccagcgccgtcataatgtccctggtcagacaggcaaaggacatgccgtccccggccagatgatgaccgattataaggagccggcattcctcttccataaaccatgcgaaaaaccgaagcagctctccatctttcagtgcaaaaggaatggatgcctggctttggatcacctctttccagtcttcttttacgtacattttccggatatggatttccttttcctctccggtttcataaaaggcacggccatcctcttctaacagtatcctgctccgcagcatctcattcctggaacaggccttccttaccgctgtctccagagcctgtatttccacctttcctccgatcactgccatgacagaaacctggatgctcggtgaaaacagatgtgttctttcttttttgatttcagccttcatgggcaaactccttataaacttctattaacagttccctgatttcttcacgaggcagactggtggtgttcgtagcggcaatggaggcaataccgtgggtgaaaacccataccttcacaaataacctggcgtctgcctgctccggcacagctcccgccagttcatagatgctgttcatccggaagctgtccgacatgcagagcagccggaacagatttttttcctgtccggcaagttccacataccgcagccccatatacagaaataacggctccccatcgggattttccatcatttcttttgtaaaaaaaactcttgtcctctcataaacttcttttttcacctcttccatattctgaaacacatggaaaatcggctgggtggagcagcccagcctgtgtgccagttcgcgcgccgtcacatgttcgaatccattttctctggtcatttcaaaggctgtttctataatctcttctttgctgagtttcgctttagggggcatcttcaacacctcttttttctttttcatatcgttcaggcgtacaataacatcgttatataacaatgttattgtacgcctttctgctttctttgtcaattgccctttgttttttcgcggcattgtctgcccgttatcggaagaactgtcaggttccagtacagcattgcattactgtgatattaatgcaacgctgtaccagcctgccgccgtacacatatcccggtccctgtccgcatatagttatagaaaaaactgtgaggcctgtatgcttcccttcctggaacacattaatcaactgctgtggggttttcccgttctcatactgttatcctccgcccatctttattttactgctaaattaaaatttccccagagacttaccttaaaagctatccggctgtccgtcacccctgaaaaaaatgcaaagggcgccaatctctcaggctttgccgcccttgccaccactctggccgccactctcggtaccgggaatatcataggcgtttccaccgctattgccatcggcggcccgggcgctcttttctggtgctggataaccggggtactgggcatggcgacctgttatgcagaatgctacttaagcgttctgttcaaaaagcaaaaaccggataagacatatgtgggcggccctatgtatgtactggaacaggggctgcacagcaaacctctgggaatcctttatgccgcctgtgcactgtttgccgccttcggggtgggctgcaccacccagtcctctgccatcaccgaggcagtgaataccatagcgccggtatctccccatatcatcggtattctcgcagcctttaccgccgggctcgtcatcctcggcggcgtgaaatccatcggcaaattctgcacgagaatggttccggcccttggctttttctatattggctgctgcctgtaccttctgttcctgaaccgtaactttattttttccggcctttccctgatacttggcagcgcttttcagacaaaagcggccgccggcggtttcatcggaagcacgctgcagagcgcagcgcgtttcggcattgccagaggccttttcaccaatgaagctggtatagggactgccgccatcgccgccgcttcctcggaaaccagggatcccaggaggcaaagcctcatttccatgaccgccgttttctgggatacggttgttatgtgtgcggtgacggggcttgtgatcgttacgaatatccagaaaaatccttcctccatcctggggttcagctccgccagccttacttccgccgcttttaccttccttcccttcggcggagctaccctgctctccctggcccttgtggcatttgccataaccactctcataggctggtgttattacggggaacgctccgcggaatacctgtttggcgaatccggtattgtatcctatcatttatgctatatcgtcatgatttatatcggcgccgtcctgcctatggatctggtctggggaatgacggatctgattaacggaatcatggtctttcccaatgtaattgccctatttgccctgcgtaaaaaaatacatatttagccctgcggctgccgcagtacgggatactcttcggttctttacagacataccgttcggagcactgccgcaggaataaaaaaagggaatcggcagaatattataattctttctgccgattcccttttttacgtttcacaccaatcataccgtttatgcagaagcacgcttatcgcctgcgcttcttcagcgcgtataatacagcacacccagagttcccggaccgcaatggctggaaatcacaccgccggccctggttatccggatatcctgaaatacatcaagcgcctccagatactgcttcacctcggcaataaccggctccggacatccggaatgagtgataaacactctgccgggatccgcttccagcaggctttcccgcatatcctgcacatatttcaggattaccttatcctgagttcccctgtatttctttcctgcggccatctttccgccctttacctcaactctcggcttcaggttcagctttccgcccagaagagccgtcacggtggaacatcttccgcccatagccagataatcaagccgttctactacaaagctggctcttaccttatccctggcgccttctatttcagccgtgatttcctccgcgcttcgtccggcttccgccagttcggcggctctcagtacctgaaggccgattcccgtagacaggtttccggaatcgataataaacatcctctcatatcccaattcttcctttacaaggcggagtacattgcaggtggttgacatttctcctgaaatgcctataaaaatcacttcgtccccattttccatcataggcctgatcaaatcaagggcacgatcgaatgcgactgccgccgttttgggtgtacgtctgtttttttccgcccaggcataaatctcatccggtccaatttcctctccgtcgctatagcttgtcatatccagtactatattgagcggaagaatggaaattccatgcttttcaatcaaatccggcgtcagatcacaggtactgtccgccactattctaatcttactcatctctgtcccctttattccaaacggtgtccttaacggattctcttaatggattgccttttccagaatcccaagccccagcggataaggcccggtatgcacaccgattgttgctccgatctgataaataggaagcccgccgatattataattaacagaaagcctttccataaccatatcccgatagctttccgcttctgccctgtcgtaaccatatcctattacaatggaataatttccgatgtcatcccctctttcccggagataatccagaagtaaatccacagttttctgcatggtcttccttctcacgcgcccgatgccggaagggaaaatttctccctgcttcaatgtaataacgggcttaatcccaagcaaggctccggccacaccggcaacctttccgatccttcctcccgctttcagatattccatgcttcccacggtaaaaaagatacgtccggtgcctttgatttcttccattctggctatggtctcctcatagccggcgccgctttcctgcatagccgccgcttccaggactaagagcccctgcaggaccgtattgacagttgcgtccatcacccggatctgcgcccggggatatttttccagaatcagcccccttgcggacagggccgactgcatggagccgctgaatttagttgttatacagatacaaaaaacaggaatgccttccttcgcataaggctcgaaggcatcataataatcctgaattcccggaagtgaggatttcggatatactcccggattatccaccattctctggtagaactccctcactcccacttcttccacttcctttaaatatgtcttgtcatcaaaagatacataaaaaggaaccacccggatatttttttccatggccagttcgggaggaagatcacaggagctgtcgctgataatttgaaattgcttgtccataatttccgctttcttttccaactgactttaatcatacatattaagttttaccactattacgctaagtagtaaaggctttttataactatacgggcttaaaaatcctgtcagccgcagctgttcggatcccggagccgttactgtcagcccttccacagatgtcccgcctgaacgcataccggttcctcatccacgctcacccagacatccatgcaggaaggattataaatcattttcatatcggcactgtacaccaggcttctggaggcgctgatataatccttgatttctatattagtggcataccagatatcttcccgtccgccggccattttacagaattcttccatgacctcccaattatccgcaccgtcgaactcaaagctgtgtccccagatataaaacagcagcatctgctgaaaatcccgtgccataaactgctcccacagctttttcaaatctccgttatgatgggccgtaggatgccatttcataaaatcctccggaatggcaaagctgcctgtagcctccacggtccggctgtattccatgccgcagtttctcgcaagcgcaatgacatgttccgaataatccccgaaaggatatgacatcccccttaccggatagccgcacagttcctccagagtctgcttatcctcaagaatttccttaagcagggccgcatccggtatctgcgtgggaaacgggtgcgttaccgtatgtacggagacctcatggttcctgtaaacccgggcaaagtcttcctttttcacatatttgtcccctcccaggttaccgctgttaatatgaaaggtaccccgaatatgatatttatcaaaaagctcagccagacggacatcaaagatctgtccgtcgtcgtagctcatagtaagcgcacgtcttactcctcccggaaataaatttgcttttactgtcatccttcttctcctctctgtgtctccttcttcatcctcatacccgtgggagtgaccgccagccctcctttggaggtttccctgacggactggggcatcgccttcccaattgcatacatggcgtccactacttcatcaaagggaatataactcttcaccccggccaaagccaaatcggcggaaagcagggcattcattgcgcctgaagcattccgcttgatgcaggggatctccacaagtcctgccaccggatcacaggtcagccccagtacgttcttaagcgccatggctgccgcatggaaagccatttccggcgttcctcccagcatctccgtcaccgctgccgctcccatggccgctgccgccccgcattctgcctggcagccgccttccgctcccgataccgtcgcccggcttcccacaatgattcccaccgcagacgcggtaaacagtgcattgatcagtgtctgcctgtcaagcccccggctttgtgcacatgccagcagcacagcgggtacaatgccgcaggaaccggctgtggggcaggctacaatacactgcatggaggcattgatttccgaacaggaaagcgccatccccacagcaagggaagccgtttctccaagtaggctgttccctttcccgcggtattgttcatatctgcaggcatttcctcctgtgaggccgctgacggattgtaccggctcttttctcgccgtagaggcagaacgctccatcaccgccagagactgatccatctgttccctgagttcctccctgctcctgccgcttctttccatctcctggtttaaggcgtattcccaaagaggctgatccccctcttcttttaatttctgaatcaacttttccgtgtccagtataaacatatctgtatcgtttcctccgttttcgataaactcaccctatatcacccggattcaggagcagtacctgcttcacgccatatacgcgctccagcgcatttttcagatgttccggcagttctccgtccagctccatatacatacaggccgtctttccgtcttccgtacggtttacctgcatattcccgatgttaatccgatatgcgtaaaggatggccgtaatccccgcgatgactccgggctcatccgtatgtctggtagccagaatgggacgttccccggaaaactgcacctccactccgtcaatttccgtaatgcagatgcttcccccgccgatactgcttcccgtcatggtaaacacattgccgctctccgtggtgagctccatatgcaccgtattgggatgcacctctcccaaatccgcaggaataaattctgcctgaatccctttctgccccgccagctcataagcgcttttgagccgttcatcatcataccggatcccctgtatccctgcaagaagcgctttatcggttccatggccggcataggtttctgcaaaggatccgtgcatatagcaaaccgcctttttaatttcttccccgcacagatgcctggcaaacagtcccagcctggccgctcctgccgtgtggctgctggacggcccgaccataaccggccctatcatgtcaaaaacaccataatgcttcactgtaaatacctcctgcttcctccgcctgctttctgtattcccataagccataaaaagccctgcaaacctgtgataagctgcagggcttctctgtcattattattggaatattttgcttatattatactgtttcgttccattacctgtccagcatttctttttttctgccataccggtcagtccttttgtccgaaatgacaccggaataattcatgccgaaggcaaaatcataggagtgtccttcttcatcgatgtatacccgcatatcgaacacacagtcctccgcctgctcttccacggtttccatatcagccggcatctgcaggggaagaagcccctccggttcgaaccggcctgaaatcacatccagcaccgactccgcagagactccgaattccgtgaggatggcatccgcataaggctccatttccgacatcaccacaggatttttaaccgtcatggaaacaatcaccggcttatccttcatctgttctctggtacggattaccatatccagatcctcttcattggcggcggtattcgtcttcccataataggaacggttcgtgaaatcctccagcggatcccctcccgccaaactcacttttctggcggccttcgccgtatatgtgcgatactgcagagtgacaggcacataaccgtttcctccggccgccctgtcttcgggactgtagcctacggaaatcggtgattccacaaagcagacagccgcatccgcctcttccggagtatccaccacttcaaacaatccttccgccgcttttttccctggcggcgttatatatgcttccggagtgatgccgctcataaaattcctgtagggacggatatgcctgtccggtatataaaccctgcatttttccttcaggggaagtaccccgcctttatttttcaaaaggacaacagaacggagctgggactcataccctttttggacaaattccggatttcccactgtatttatggactcctccaaatccagataaggattttcaaataagcctgtacggaatatattctgaagaagcctcaccgcggaacgttcaaaccgcttccgcatggcctcctccccatatatttcacagcccatgcgataggcttccagaaccggctgcacgtcgttattgccgccgaactgatccacgcctgcttccaacgctttcagatgccgctgcgcttccgtgagcccctccactccccagcatttaccggcgaattcctcttccgtcgagccttcatcatgcgtaattccccagtccgtgcataccacaccgtcatacccaagctgctccctgagtaaatcaccgataagataacggctgaaggaatttcccacattttctccattcaccttatcctgtccataggaaacggtatagtatggcatcaccgcgctggcgcattctgttccgtcctccagcttaaaggctccctctgtaaaaggcttcagatgctcatcaaaattatttcccggatataccgcatattttccataggcataatgggcatccctgcccgcctcacaggggcctccgcccgggaaatgcttcaccatggtgtttacactgtctttgccccagccgtccgggcttccttccgtagtctgaaaaccgtcgcaataagcctttgtcatggcgacggtaagctccgtatgttctccgaaggtgtccgggaaccgcatccagcgcggctccgtagccagatctatctgtggtgacagggctgtggcgattcccaatgcccggtactccctggaacctatttttccgaattcctttacgctctccggatcaaaagaagcggtgagaccgatgccgttagcccatttggatatgggttcgcctgtaatgcccataaattcggcgctgcttccgctcccatgtctgggatccgaactgttattggcaggaatcccgaagccggtattttccgcaagagcctgcatcctgttattccagcgcaccgcagtttccgtatcctttaatcccataatcagcacatgacgaaccttgtcttctgtcaggaactttttctgctgatcggtcagcgcccagggttcttccccgctctcttcaaagcttttgccgccatacgtcgccgggaaggggccggggccgctttgggccggaataatctggtgggcgctgtaaagcatcagccccgcaatatcttccacgggcagccttgccgccaaatcttcggcccgttctctcgcgctgagtctccagtcctcataaggaaccagctctccggttcccagaaaatccttgaacgcatgtccgtccaccgtcaatatcttcactttgctgccgtcggacacccccagagctttgccttcttcattccgaatcagacgataaccatccatctgcttttcttcccacaatttttccatgccttctccttccatattaaagccatttgaatctattctttcattatacaggaggattcttccggatgccagaggattcttgccatataaatttgcagagaataacattttgattaactatctaacttttgggtcgatatatattaatatttgagttttattaaaattatagaaggagatatcatgtctaaatcaattgcacgaaaactatcttttgcaatcatcatcgcagttatgttctgtactctttcaattggtattatcagttttatttttttccgaaatgcatctatagacagcaatgcccagcgggcgcaaaacattgcccagtccgccgctgccctggtaaattcttctgattttacccaggtcattgatacattggaaaaaaacgacagttggtattatgccaagcaggcactggataaagtaaaaaccgacacagatgtagctttcctctatgtacttgatgcaaggattacggataatgcgacctattacatagagggttttaatcccgccactgattttgaggaattcgatctgggcaccaaagaaagcgtcgatgcttatgatgagaatctgtttaagactatctcttcaggccaggcgcgtgtaaccggcatttatgatgcgggcggttacggcaatatggtaaccggctatgctcccattaaaaatggcaacaaggttgtgggcgtcgttggcgttgatattagtcttaacgatgtgatgcaggaagtctatatgtttgctctgcgcctttttctcatcgtggtaatattctgcatcctgttcggctttgtcagtgtgagactggtcaacaattatttaggaaagcccatcgttgaactgacaaaggccgcagatttgctggctgagggcaatgtaaatatcaacatttcgatacagcgtaatgacgaaatcggacagctggccgcatccttccagacgatgattcacggtatccaagcccagatatctgttatggaagaacttgccgacggtaatttgaacatcactcccaagctcagaagcgaacaggatgccatgaataaggctcttgagaaaatgattcataagctgaatgtaatgttccatgaaatcctctccagcgccaatcaggtttccggcgcggcgaaccagatttcaatgacttctcagcagctggccagcagttcaatccagcagacctcatcaatcgagcagttcgccggaaatgtcgcccatgtctatgaacagagcgaagtaactttgagcaaaacctctgatgcccattctgccgacagcgatgcagggatcattattcaggaaagcacggaactgatgcaggatatgacagatgcaatgaacgacatcaacaaaagctccctggagatttccaatatcatcaaaaccattaacgatattgcatttcagaccaatattctggcgctcaacgcagcggtggaagcagcccgggcaggacagcatggcaaaggctttgccgtagtcgctgatgaagtccgcaacctcgccgcaaaaagcgcacaggcagcccaggaaacctcctctctgattgaaagaagcgcagagaatgtcaagcacgggaataaaatcactaatacgaccagagaaagtctgggcaaggtagaaaatatctcccggcgtatttcagaagtactccgtcatatcgactctgccgctgaactgcagaaagagacgattgtcggcatgaaccagtccgtagaacaaatctcctccttggtacacaacaattccgctctggccgaagaatccgccgcatccgctgaagagcttgcagcgcaggcgaatctgctcaatcagattgtatcaaacttcaggctgcgcaatactgaaaatgtgaactcccattaattatcgaatcatccgcatgtgatatttacatccgtgctgcatcagcggcctgaccgaaagaactgtttcacacagtcctcccggtcaggccgtttttgatttattgatacaggcaacgctgaaaaggttagaaacaaacgtgcgccgccgggcgcacgaaaaaacagaaccatcaggagaatgaatcctgatagttctgctctataattatctttatttcattatcggtccggatacctgtcgtttccgaccggatggaaacggcttcttacagacctgcctgagcagcaacctctgctgcgaaatcgtcaaccttcttctcaagaccttcgcctgtttcaaaacgaacgaatttcttaatggaaagagctgcaccgttttctttggcaacctgctccacatacttggcaacagtcaaatcaccatcttttacgtaagcctgctcaagcagacatacttccttcaattcctttgcaagacggccggaaatcatcttctcgatgatattagcaggcttgttcgcatttttaggatcattctgtgcctgagccatgaggatttctttttcatgctctttatattcttcaggaacatctgctgtagccacatacttgggagccagagcggcaacctgcattgctacattggacagacactctttaacagcgtcattaacaacatccgtatcggcttctacaataacaccgattcttccgccgccatgaatataagaaacaacacagccatgctctgccgtaactttctcaaatcttctgatattcaggttctcaccgatagtagcgatcttctctaccagagcttccttaacagtcttggcaggatccgcattccatgcttcagccataaaagcgtcgatatcagccgcgtcagtattcactgcctgctctgcaacagctgcaacaaattcctggaagctttcattctttgccacgaagtctgtttcggagttaacctcaacaactgctgcggatgtatctccctttaccgcaatacggcaaagaccttctgctgcaattcttccggcttttttctctgctttagcctgtccgttctttctcaggaactccatagccgcttccatatcgccgtttgtctcatttaacgctttcttgcagtccatcatacctgcgccggaaagctctcttaattcttttaccattgctgctgtgatagccattctattttcctccgcctttctgtatcattcttgtctgttatgcttattctgcagctgctgcttccgcttccactgcaacttcttcgatatctgttgcttccgtggcagccagagcttcttcatcataaacagcttcgccctgatttgcttcgataactgcgtctgccatcttggatgtgattaatttaactgctctgatagcatcatcattaccaggaatgatgaaatccagttcttcaggatcacagttggtatcaccgataccaatcagggtgattcccaggatatgagcttcctgtacacagattctttccttcttgggatctactacaaaaatagcatcagggattctggtcatattcttaatgccgcccaggtttctctccagcttttcccattctttcttaatctggataacttccttcttgggaagaacatcaaatgttccgtcttcggccatggtctcgatctgtttcagtctttcaattctgcttctgatggtcttgaagttggtaagcataccgcccagccatctttcatttacataatacataccgcagcgctctgcttcagccttaacagcatcctgagcctgcttcttggttcctacgaaaagaatggttccgccctgtgctgcaatttcggaaactgcattataagcttcatcaatctttcctacggacttctgaagatcaatgatatggataccatttctctctgtgaagatataaggagccattttagggttccatcttcttgtctgatgtccgaaatgaacacctgcttccagtaactgcttcatagaaataacgctcatgtttcttacctccgtttggttgaattcttccgtatgcttctctggaatactcagcttccattcccagccacttccgcgttaaagaagcaccggactggaaatccacatacgtgatttttggtcacaacatttgaattatagcataaaaaatccccctgtgcaagggggatttaccaaaatcagcctgattctgctgatttccgtttatcaggacttcatgctttcttccagcttcttaacttcttcaaaaacaacattatttcttactttaatataagtgcccttcattccggaggaacgggactcgatgattcctgcactctcaaactttctcagggcattgactataacggaacgggtaataccggctctgtccgctatcttactcgctaccagaactccctccaggccattcagttcctgaaagatgtggatgatagcctgtgtttccgaataggacagcgttcctatggcagatttgacaaccgccagcttcctgctttcctccgcactctcttcactgacagacctcagcatttccaggccaactactgtagttccatattcacagagaataatatcatcgatatcgtaggtctctccatggcggtagagaaaaagggtgccgagtcgctctcccgcaatctcgatgggagaaacaaccgccgcgaatttcatgacagactgattttcaaatcccaatgtcgccagattaacattttccttggtggaaaggacggaaagaagcctctcattcagcataggatctataaaactacccacttcgtccttaagcagctctgcaataacctctttgttatccgctgtggcaattcccagtactttgcctttacggctgattactaatacattggatgcgagtatttccctcataaccttgcatatatcattaaaagccaccttactggaattgttgttgtgaagcaactttcctattttccgtgttctgtccagtagttgaacgctactcatgttagtttttcctccggcagaatgcccaaacttatgacactattgtagcacagacacccgtcagacgcaacgcattttgtcactccgaccgttgcagcacttgtataccggacgacccaggcactaacagccatactgagcagttcttatacttcttccgttttcttctccatcacataaccacattcttcattatagcagaccagtttgtttcccttttccagcattatggaaccgcactgggggcatttttctgccgagggcttctgccacaccatgaaatcgcattccggatttccgatgcagccatagtactttctgcccttctttgtctttttcagcacgatgtctttcccgcatttggggcaggccactcccaccttctcaaaataaggtttggtattacggcattccggaaaaccgggacacgccaggaacctgccgtgagggccatatttaattaccattctcctgccgcacagctcgcattcctcatccgattcttcgtccgcaatctgtacctgttccagatccttttcggcctgctgaaccgcttcatccaaatccgggtaaaaattggacacaaccgtcttccagttcacgcttccttcttccacaccgtccagaagcgcttccatattggccgtgaagttcacatcaacaatcgtggggaatgcttccttcatcatggagtttaccacttcacccagctcggaaacataaaggttcttattttcctttaccacatatcttcttgccagaatggtcgtaattgtgggagcataggtactcgggcggccgattccctgctcttccagcgcccttaccagagatgcttccgtataatgtgccggaggctgggtaaaatgctgatcctcctggaagctgtcgaaggtgagctttgtattcttatcaattccctttaccagagtattattttccgccttctcgtcatcctcctgtgtataaacgctcataaagccatcaaaccgtattttgcttgccgccactgtaaaacgatggcctgcagcatcgatcttcaccgatgtcgtctcataaacagcaggagtcatacggcttgcaacaaaccgtttccagataagctggtacagcctgaactgatccctggaaagggactctttcagttccagcggaatacgggaaatgtcggtggggcggatcgcctcatgggcatcctgtattttctggccgctctttttctcctggcttttagcccccgtatattccgggccgtaagctttttcaatatacagtgcagcctgatgctccgcttcctcggacacacgggtggaatccgtacgcagataggtgataacacccaccgtgccgtttccttttatatcaattccttcatatagctgctgtgcaaggcgcatggttttctgggtggaaaaattcagcaccttgctggcttcctgctgcagtgtggatgtggtaaacggaagaggcgctttttttaccctctcgcccttcttcacatcggttacctgataagccgcgccttccagctccttcttcaccttttccacatcttccgcacaggtcagattctgcttctggctcgtagtgccatagtatttggctgtcagcagctttctctcgccgggaagcttaaaggaagcatccagcgtccaatattcttccggtataaatgcgttaatttcatcttccctgtcgcagatcatgcgaagcgccacggactgtacgcgtccggcactcaagcctctcttgaccttcgcccagagcagcggggaaatacggtaccccaccatacggtcaagctcacgcctggcctgctgggcatccaccagtcccatatctatttccctcgggtgcttcagcgattccttcaccgcattcttagttatttcgttaaaagtgatccggtaaattttctttccgtttttttccaggttcagcgcgttggtcaaatgccaggaaatcgcttccccctcacggtcagggtccgttgccagatatactttttccgcttttttaacctccttgcgcagattcgccaggatatcccccttaccgcggatggtaatatatttcggttcataatcatgctcaacatcaattcccagctggctcttaggcagatcccgtacgtgaccgttgcttgcagccacctcataattcgggccaaggaacttcttgattgtttttacctttgcaggtgattccactattacaagatattttgccatatagaccttttatctccttctcctttgcgccgatgggagtttctctatactcctgcgcaactcataccaaatgtatcagataatgtaaggctgttaacccgttcccttcgatcgccggacatacgcaaaacagccagcaatcgtgaaccactatacaccatattttctgccgtggcaaggaattttataaaaatctcatgtttattttaggaatttacaacttttcaccggacaggaaaaaatagcctccttcctgttttaccgcaccttccatctgcagctccagcaggttctgcagaagctggggaagggacatggaaatcccttttttcttcatctcttcataaatattgtctgccgcccgtggagtgaaatcaaggaagcttttcactccgtcctcagccggttcctcttcggcaggcccgtctgaggctgccgcattcttccggaattttttccggtttttggcaagctcctccagaagtacatcagggctgcaggccatgcacgctccctgcctgataagctcattacagccgctgctgagggcatccgttatccttccgggaaccacaaatacctcttttccctgttccagtgccatatctaccgtaatcagggtgccgctcttcattctggcctcaaccaccaggacaacatcggaaagcccgcttataatcctgtttcttacagggaaatgagcagccttgggaagcattcccggagggaattcggacagaatgcctccttgtcccggtatcctgtcataaattttcctgttttcttcgggataacagatatccaccccacagcccagaacggcataggtcttacctccggcccggatggccgcttcctgactgattccgtcaatccctctggcaagcccgctgataatattcactccggcgcgggaaagcgccgatgcgaaccaagaagccacatacctgccgtactccgagcacattcttgcgcctatcacggccaccgccggcttcgtctcttccgggagttcacccctgacatagactcctgccggcggatccggaatggaagaaagcctgcgcggatactccggatcagaaagagggatgaaacggattcctcttgaccaaagcttctgatattccctttttacatctttttcctgtcttgctttcagaaaattcatgagttgggaaggacggagcattccggccaaagctttttcttccattccatataccttttcggcacttcctgcttccctgataaggcgcagaactgtaattcttcctattccttctatattacatagccaataagaaaattccctttctttttccgtccgttcattcttcactgcttttcctccagtattttccgcctgccatgcggtaacaggcggcttcactcaaatgaatttttccgatttgctcctccccgtccaaatccgccagcgtacgggccagccgtaaaatccggtgatatcctcttgcgctcaatccgagcgtatcaaaaagccgttccatatactgctgctcagaaagcccaagacggcagaaaatacggatatctcccgctcccagctgcgaattgaaccggataggcatccctttatagcgctcctcctgcctggctctcgcttccattacctgtgctgccagctgtctgctgtcactgccattcttttttccgcttcccgtcagtcccgcgaattccatcctcggcacctccgtacagatatccatgcgatccagaatagggccggaaatccggctcaggtatctctgtacctctcccggcgtacagcggcactggttccgatccggataatagccgcagggacagggattcatggccgccaccagcataaaatccgccggatagctgaaggttccgctgctccgggcgatctggacccggtgctcttccatgggctgcctgagcagatccagcgtttcccttctgaattccgtcagttcgtccaggaacagaatccctctgtgcgccagactgatgacacccggacggggaatcctgccgcccccggtgagggcatgtccggtaattgtatgatgcgggtttacaaatggccggtccgtaatcaggccggtcccttcctccagcatccccgccacactgtagaccttggttacctccagctgttcctctttggataaaggcggcaatatagaagacatgctccgtgctatcatggtctttcccgtccccggaggcccgatcatgagcagatggtgaaacccggcggccgccaccaccgccgcccgcttggcgctttcctgacccctgatttccccgaaatccaggcccggccgttttcctgcggaaatattcccgttacagaccggttccgtttcctccccatcctttccttcattctgcaaaaggctgtccagaagtgccgccagattaccggccccggttatacggataccttccaccagcctcgcttcctttgtattttccagaggtatgatacagcggctcatcccctgtttcttcccctccagaaccatggggaggatcccgcgtaccggtttgatatcaccattaaggcccagttctcccgccatcagtgtattctctacatattcctggggaagtatgccaagagccacaagaatccctgccgccacaggcagatcataggcggttccttccttatgaaggcttgcgggggatatgtttactgtgatgcgcacaggcggaagcgtcacctccgcatttttaagcgccacacggattcgttccctggcctccttgacctcacttcccaaaaggccgaccatttcaaagcccggcagccctcttgatatgtccacttccacccgggccagatagctttccatgccatgcagccctccggtataaattgtactgtacattagatttctccttataaggaataggatttcgctcacgcgaagacagaaataacagaaatacaagaaatataagaatgtttgaatcagaacagaaaatcagacaaaaacagaattaaattctaccgcgggacaggaatcttctgcaggagctccatataccctgtttcctccctgcccgagtcttttcccggcgacagtgctgcagtcctgacaggaggctcagacaaaggaagaaaagggaggctggactgcatactgcaattttcttatgtataccggttacaggtaatgaacttccattttttcaaaaccttcccgcagcttcgtcagcgctcttttttcgatgcgggaaacatagcttctggaaatattcagcttttttcctatttcacgctgtgtaacctcttctcctccgcacagcccgtaacgcaggcagataatctctttttccctgtcggtcaacagagaattaatcaggcccgacagctttcccagacttctttccagttccatctggtccacaatatccggctgttcctggggcgtcacatccagcaggctgatctcatttccctcccggtcagtaccgataggatcataaagcgaaacctcccgggatgtcttttttttgcttctgagcatcatcaggagctcgttatctatgcacctggccgcataagtggccagcttgctgtttttggatgcatcaaaggattccaccgctttgatcaggcctattgtcccgatggaaatcaggtcctccatatcttcatccacgttctgatacttttttgcgatatgggctaccagccgcagatttcgctctattagtacctgcttggcttccctggcttttacgccgtcactcccccgcagcgcttccagacacgcgctttcctcctctttcgacagtggtttcagaaaggttttcaaaaggagcccccatagtcaatttaatactattctatgtgacgaatggggttatagtgccagtacttttcgaaaccttttaatcgaataaaaattcagaaagagcataattgctcacatctataccaaaatccgtcagccggtaccaggtatcatccctgccgtccgcccctttttccacccggacaagaagcccttctctcaccagcttatcaatggcagccgcataaatattttccagactttccccgaactcctcataaaaacggcgggccgaaaccccatccgccatacgcagccccaaaaacataaattcctccatctgctcctgcacggaaagcttctgcaccgacagcttcagatgtgtttccatccctctctccccggaaaactccagataccgtcccatatccgccgtattgctccacctcacattaccgagcagagacgccgctcccacaccgaaccccgcataatcaatccgctcccagtaagaaacattatgacggcacgcaaacccgggaagcgcataattagatatctcataacgcccatatcccgcttttcccagaatctccttcgtccgcccatacatcacccgatcctcatcctccgtaggaagaggcagccgcccggcctccgctccatccccgcttttcccataatactcaaaaaaaggagtcccttcctcaataataagactataagcggaaatatgctccggtttcagccgaatcaccttcacaagcgtctccgcccacccctcaggactctgccccggaagcgcgctcatcagatccacattaatattaccaaacccttccttccgcgccatctcataactgcaaagaaaatcctcccaagtatgaatccgccccaaagccttcaattccctatcatccgccgactgcagccccatactgagccggttcacccccgccagccgataccccgaaagactctccctcgtcacagtcccgggattcacctccatagtaacctccaccccgtccccaccgaaagaaaactcctcccgcagacaatccatgataacaccaatctgttctccggaaagcaaagaaggcgtacctccgccaaaaaacacagtcctcacctcatgccccccataaagagacgcctgaccccgaatttccctcttcaaagcctcaacatattcagttttcatctcatcatcaccgggagccgaaagaaaatcacaataaagacatttgcgaacgcaaaaaggaacatgtagatagataccaagggaccgcctgccgctctcaccacttcgctgcatacttcttattcctacccttcaagaataccccttccatctgctttccagcataccagaaaaccacccatctgaaaagaggcctgattattaaaactttctaaactaaaatccaactaactaacataaattcccaactcatttaatcctaacctactcacttcccttagtgccctttttatcctccaaaaactaccgcggccggctccatcccgcctttggatatgccgtccccggcgtcgtctttccggcctgtgtccggcggcgttccctatggttggacggcggcatctcaaaaaaagggagctgtttcttactattttgatcctctactccgctgcccgcccttagcggcgctgtctgacgaccaaagggaggagttcagccgcgttggcagcggagttgagggacaaaatagttagaaacagcccctttttttgtctgccgccatccaaccatagggaacgccgccggacacaggccggaaagacgacaccggggacggcatatccaaaggcgggatggatccggcctcacaacctacttcttatcatccaacttcaaaacactcataaaagcctcctgaggaatctccacattccccacctggcgcatacgcttcttaccttccttctgcttctccagaagcttcttcttacgcgtaatatcaccgccatagcacttggcaagcacatccttacgcatggctttcaccgtttccctggcgataatcttgccccctacagcggcctgaatgggaatttcaaacaaatgcctggggatttcatccttcagcttctcacacatcctgcgtccccgttcataggcgctgtccctgtggacgataaaggacagggcatccacctcttcccggttaataaggatatccagctttaccagctccgacctttcatagtccttcagctcataatcaaaggacgcatagcccttggaacgggatttcaaagcatcaaagaaatcgtatataatttcattcagaggcagctcatatttcagaagcgctcttttctcttccatatattccatgctcagataacggcccctgcgctcctggcacagttccataatggaaccgataaattcgctggtcaccataatttccgaactgacaacaggctcttccatatattctattacggaaggatccggcaggttggaaggattcgtcagctccataacctccccgtttgtcttatgcaccttataaacaacgccgggagccgtcgtcactaaatccagattatattctctctccagccgctcttcgattacttccagatgaagaagccctaaaaaaccgcagcggaagccgaagcccagagccgcagaggtttccggttcataaaaaagggaagcatcattcagctgcagcttctccagcgcatcccgcagatccggatacttggccccgtccgccggatacataccgcagtataccatgggatttaccttcttataaccgggcagagggttcgcgcagggattccgggcatccgtcaccgtatcgcccacagcggtatccttcacgtttttaatggaagcggtaatatagccaaccattccggcagataactcgtcacaggggataaactgccctgccccgaaataacccacctcgaccacctcttcctgtgcgccggtagccatcatacggatggaggttcccttgctcaccctgccttccataatacggcagaaaatgataacccctttataggaatcatacagggagtcaaaaatcagagcctgcagggggttgtccgcacttccgccgggagccgggatcttgttcacaatctgctccagaacctcttcaatgccgacaccgttcttggcggaaatcagaggcgcgtcatgggcctccaaaccgattacatcctcgatctcttctttcacgcgatcgggttccgcgctgggaagatctattttattgattacggggaaaacatccagatcatgatccagcgccatataaacgttagccagagtctgggcttcaattccctgtgccgcatccaccacaagcacggctccgtcacaggcagccagcgaccggctcacctcataattaaaatccacgtggccgggcgtatcaatcaggttgaaaatatactcttccccatttttggccttgtatacggtacgtacagcctgggatttgatggtaatgcccctctccctttccaaatccatattatccagcacctgttcctgcatttccctgctggtcagaaggccggtcttttcaatgatccggtccgccagtgtcgatttaccgtgatcaatatgggcaataatacagaaattcctgattttactctgatctatagacataaaattcctccaactcttttgcatatacggaagcacatgtgaaactcacatgtgagtttcacatgcacaagtatagcaaaatcagtgaagtcggtcaatacaaacccttaccggataattccagatccaggatgtgcgctataggggcacaggcatttttgatttcttccaccgtattcgtctgggcgcccagctcgatcaggagggagcggggcctcagatgcatgttgtaacgatagcccttcagatagatccttctcgtcagtccgggataatattcattggcaattacctgcatctggaaggaaaatgccaggttttcatctatgtatggattctgcagataatcaatatctccatgcgccttggtataggaaagcccgttaaaaaacataaactgagccgtctgcttcccgttcagatccattaccagcttcctgccctccaatacttcatccctgtgcagatcgatcaccacttcgattgtgggattctccgccagcacctgttcaatggcaggaagggagttggaataggcataatctctggattccacgtcatacatacccatatggtggattacgttatagccgtattcctcccgcagaatctgcgccagcagctctcccgcccccattatcgtggtggaaatatcccccggcacggaatccacaaaatcctcctgggaatgggtatgataaattaaaatctggggtacatccggatttttggtgattgccatggtctttcccagcagggcatccaggttcagccgcttgggattggcctccgtagtggcgtccaccgcgtagaattctttgatcagggcatcaaaatcctgataatagctccagttatattcctggcttcttcctgccgcctttataaacccaaactgatccggggctggcatctggacttcctgctgctcaccgtcctgatcctggcctgtctgattttcttcctggagcagctgtgtcatattatcatccagacggatctttccctccgatgtctccggcacctccagcgcatccccgtcttcgctttctgtgtactcgctcgccccctccagaagcaggatcttttcataggtactcccgctctctgtctgcagattttcattatcctggctgccggcatacgcaaaaagagggacctgctggcctaaaatctgctcaaaccaccctctccctgaagcactgcccttatccgcaaaagcaaaagaaggcagccagacattaagcacaccttcctgcgccctggctgcaaacacttctttccatgagaaatgttctccctccccttcaccgaccgagctgcggccggaaaacaggaaatcccccatcgcgataataagaagtacaagcacacatttatgaaaaatttttcttccattccattttttattcatagaagaatatatgcacctgtacttcttatttatgcagattattacgcaatatccaaagctatatttattgcttccgaaatggtaaagctgaggcgtttcacagtttcatcgatatccttgctggttacgtacatattattcagttccgacagcgctttgggatgttccctgttgaaaaaatatccctcttccccgctttcctgtatcatgctttcaatggcatcccctacgatcgtcgcggcatccaccactgtgggcacccctatcgcaattacaggaattcccaggctttccttattaatagcattcctgtggtttcccacgccggaacccggatggattcccgcatcggaaacctggatagtccggttaagacgtttcgtgctccgggccgccagggcatccacaacaaccagtgcatccggttttgtctgctccacaacaccctttacgatttctgcggtttccattcccgtcatagccataaccccggggacgatactgcttatcatgtgcattttttcgcagccgtaggccgctttcccgtattcctttatcacatgcctgttgatgaacagattatccaccacttccggtcccagggcatctgccgtgacatccctgttgccaagtcccacgacaagaatggactgttccttctcaatatcagggattaaatttctcagctgtttagccagttcctcagaaacctccctgtgatagtcctcgtccggttctatcagcgccggcgcttccagcgtgacataggtgcccatcggttttcccatggcctttgctccatttttggtgtcaatgatgacacgggtaatctgaacctcacttttggggttatgaaattcctccacccggaccccccgtaattctccgtctgcatccgtaatgctttctctggcttccaatgccaggtctgttctaacctgaaaacaactcatctgtactctcccgctctacactttactttacattatgcgtccgtctcattcttgcccgctgacattcttcgggatttgagctgcgcaaaatgtgatatgcctattttttgcaaaaataaataaattatgtattgacatataactggtcgtccgatagaatatattcgtatgtttccattagaacgaccgtgtccgggtttaatgaaacattttcataaggaataagaaaaattcacttgaaaatggaggtgaaaatcttggctaacatcaaatctgctaagaagagaattctggttaacagaaccaaagctgacagaaacaaagctatcaagtctggtgtgaaaacttctatcaagaaggtatacacagctattgaagctggtgataagagcgcagcacagtctgctcttctcgctgccacatctactattgataaggcaacaaccaaaggtgtatatcacaaaaatacagcatccagaaaagtgtcccgtctttccaaagctgtaaaccagatggcataattcagatatacagagtgtatgctaaaatccccatcctataccgtcatgtaggatgaggatttttttcattctaatcttctttttcgtcagaaaaatatttcactttcccttctttatctaaataaaggtaatatcttccttcttcgatttccagataaagaggatacattcctccttcttcaaagcattccagaaaggcaatctgattatcctccagaattttttccgcttcctccaccgtactgccggcctcacacggttccagcagagcccgtatgtcctcgtctgaaagctcgaagatatctataggaacgaaactgtccgaatattctcttgtagcaggctgcagcatgtccccttccagctgaatggttctggctttatcaccgagctccaggccgcaggccagcagggttccgtccttcagctgtacgaacagattatcattatagctggtattataggtcatgaattccggcatctccgtccggctgtcctgaaacatcatccgttccggccataccattttcacattgtccagtaccttttccggagtccgtacataatcatctcctgtcacctctgtcccgcactgcccccatatattaaggccccatgtatacaaatctccatcctttgttatggcggctccggtccagtttccggtagttgcataaacgcagtcctccaacatgagatgcggcctggtatacatcattttgcggggattttccggccattcctctttataccaatagccatccgaataggaggtcgcggaaagagccttatattctccccaccaccagacactgccgtcctccttcagcgctacgacagaatacataccggcccgtgcaaaggccacctgttccataagaagcgtgggttccagtacctgtgaattttctccgaaatcatcaaacaaagattccgttcccggctcttttcctaatacccccatcatattcatacccatgccgtacagctttccgtcttccgtcagatatatggtgaaatagccgttcgtggattcatccacggaaactacgttttccgctatctttatcggttcctgatagagaacctccaggtcatccactcttcctattcccaactggccatagctgttgcggccatatccccacagcaccttgtcatcatcaatgaaaaaatgattatccacagtcacacggtttgtcatatgataacgttccaactgaaagggttcgtccagataaagttcctccaccgaatctacgcggaagacttttacaggctgcgccgttttcgtcttctgctcgtttccggaatcactttccgccggagctgtgccgtcttccctttgattcccgctgtcttcccccgcaaataccaccgacatggacaggaacgaaaccgctgcaaaaagcacgaaggccgcaaggtacccggtctttttctttttatccgtaaaaagattattcagccgctccttcattgtctttttccctgatgagaacccggttgtatatgaagtgccgtttccctgagccagttttataagcatacttccgtagcgtttcttctcttccggatccatattcccggcggcacggctgtcacaaacacattccacatcaaagaaggccattcgtttcatgatccggagaaccggattaaaccagtaaatgtcacagaccgctaccataagaagcttgtaccacaaatcaccgtatttgtaatggcacagttcatggcgcagcatcgcctccagctccggcgcattacaggaattcctgtcaatcagcagcaccgggctcatatatccggttaccatcggggtaaaaacatcgtcgctcactaatatcggaattgccttttttatgccatattcctgaaaaagcctttgcgcgagcaaatccgtccttttatccctgcatggacgggcggcttccaaaatacattttctggtatgcagatattgggaaatatggaatcttgcggtaatcagcaaacccgccagccaaatgcacgccagaaatagtcccgaaggcagccggccatgagtcatggtgtcttctttctgcgggagttcttccgtcagcgggagttcttccatctgtcggatatcttccgtccgccggacgccttctgagcgttggacgctttctgcctgtcgggcgttctccgccgcagaatccgctgcattttcatttccggcagctggtgataaagcctttggaacagttcctgtatctgcagcgggccctgcttctatttcttcttccgggctttgcaaatcaccctgcttttcctcagcggcagggagactcacccgcagcaaaggcagccgctccgaaatgtccgcaaaagaaacacttacagggatcagcagcctgaacgccagaatcagccagacaagctttctccaccgatatcctgacccgctccctaaaaatacggaaagaagccataccaatcctattaaaagatcggcaaacaaggttattttcaaaataccaggcaggaatcctgtcatctcttttttcctccggagggtgtatgcttccctgttttactgtctataaaatcctgaaggcaggcgatatcttcatcactcagctcttctccgtcataaagggctgttgcgaagttggatatggagcctccgaacatacgctttaaaatatgccgtccggtttcttttaaataaggttccttttccacacgggcgctgtaataatttattttgcctctcttctccctttctacgaagcctctttcctccagacgggaaagaagggacagaatcgtacttggcagcacttccctgccttcatccatcctttcctcaatctccattctggtaaccggcccttcggcatcccagataatcatcattaattccagttccgcatcaggcagtttcttcatattaaataatcccccgtttcaaattagtcatttgtctaatttaagagtataacaaatcatatagattgtcaaatgtttttctacatttgtctcgttttctttccgaccgtcttcctttttccgaaacggtctgcttacgatatctctttcttttcgcccgctccaataataagcgttatatatgcaaaatcatgggaatacttaaaaaaatcgcaaaaaaaatgatccattctctgtttttggtgtattatagatgtagacaaggaggattttactatgcttgaagaacatgtaatgctgcagtttttaagaaaatttgatgaatatccctttctggtgaaaatggacggaaaggaatatctcatcggggaaggggatcccacttttaacgttcaattcaataaagagattcctctttccgatttagcgacaagtacttctcttgcactgggagaagcatatatgaatcatgatctggaagtcgaaggcgatttgtacaatgcattggatcattttctgggacagatgggaaagttttcagcagaccataatgccttgaaaaagctgatacacacttctaccgcaaagaaaaaccagcaaaaggaggtaagcagccattatgatatcggaaacgatttctacaaattatggctggatgagaccctgagctattcctgcggctattttcttcacgaagatgataccctgtatcaggcgcaggtcaataaggtggattatattctgcagaagctctgtctgaaagaaggtatgaccctgctggatattggctgcggctggggtttcctgctgattgaggccgctaaaaaatacaaaataaagggaaccggaatcaccttaagccaggagcagtacaaggaatgccaggcccggattaaagaagagggactggaggattatctgactgtggagctgatggattaccgtgatcttcccaaatcacatctgacctttgatcgggtggtaagtgtggggatggtggaacatgtaggccgggagaattatcagactttccttcactgcgtcagccagatcatgaagcccggcggattgtttctgcttcattttatcagtgcgctgaaggaatatccgggagatccctggattaaaaaatatattttccccggaggaatggttcccagcctgcgtgaaatgatttccggcatggcggaagaacaattccacacaatggacgtagaaaatctgagactccattataaccgtactcttctatgctggagaaagaattatctggagcatctggatacggtcagaagcatgtttgatgaaaaatttgtacgcatgtggcacctgtatctggccgcctgcgcggcaaccttccataatgggattatcgacctgcatcagatccttatgacaaaagggataaataatgaacttcctatggtcagatggtattaaagatcggatggcatctatatcttacagcaggaagtgaaatgtacgcccgcggacatttagtccgttgtccgcggcccaaaacaggagagaccctcacagagcctctccatttattttctttataaaagctgccggccttgcatccacttccacccatgcaggctcgaagccgcagcgtatcgcgttacggacagatttcaggttagcccaggcagcacaataaaaggggaccttccctctttccagaatttccaatgccagccggcttgtcaatgccgcagcaattccccgtcttctgtattccggcagaatatcaactcctatctgccacatggtatcacaatctgcggaacaccccgccaatcccaccagctttccttcatgccaggcccctgcggcaagaacatccagttccctgcgctggctgcttaacgcattgctccactgaggaagataaagtgactctaaatcttcaggaaaaagaatcctgatttcgtaatcacagggcatggcccgcagacgctcgctgtccggcagaaaatattctgccataaaacagatctgccgatcatctctggcaaacagatcgttgagaagatacaggttaggcttcccgaaacaatgaccaatctgaaacctgcccagatatttttccacttcatctgaaacagccggatctacagaagccacaatattgtctccataggatatcagcatacagtacgatggaagctccagatatttccttgccttctcatttgctttggaaatcactgtcctgttctgtccgctgatgaaatcctccgggcggcagttggcgtctatcgcggattgttccagtgcgatacgcatgatttcttcttttgtcatttccttttttcctcctgccattggactgtctgcttactttctgtctcctctagtcttggacaaagcatgctattttttccgcaataccgccatccccgcataatgccggattgtaaattcctccggtgcaattgtttccagcagacggcggtgttctttggtaaatgcttccacctcttcctcagaaagcgatgcccctattcccctacaggcccggatacgtccatcccagctttctcttgtgaagggtatctgcagatcatagatttcattgctttccaccgtaaaatactcctcataggcttccggcaccgcaatgtaatgtctggtttctcccctgccggtccatgagggattatacttaagcaccagttcttcactggctccggcaatgggatcctcctcaggcagccaggccatatacagaatgacaaaacgtccggaaggcttcaatacccgggcaagcaccggggcaagctgttcatgcttaaaatagaaatagcactggcatgccgttaccacatcaaagcttccatcagggaaatccaactgttccgcaggcccgctgaggaaacggatatccataccggcctcctctgaaagtttttctgccgtcttaatctggttttcagagatgtccattccggtaaattctgcgccataaggatagaggtaccgggggagcacgcctgtacccgtacctagatccagaacctgctgccctttgatgcaaaggccggcatcaagaattctcctgtaaaattccggcggataaatatccctgtattttgcatagtcaccggaggttttcccccagtcaaaccctttgcctccgtcaattcttttatcggtaatcataatttatccccctctttcaccggcgccgtcagttctatatggttcccttcgctgtcctcaaattcagaaacccaattatttcctattcttttgcattcgaaaaataccgggagaccctccagtttcttcttcagaatatccaggcagtccacttccaggctgggcaggcagttactcccgtaggtatgatcttctcccgctttttcataagcgaagagccccagcctgaatccattcacatcaaatacactgtaaagctcatccctgccggtcacgggctgctccaagaaggattcataaaaccggatggctctgtccatatcctttacacaaagatacaaagaacggatcgtacaattcatattctgcccctttcctaattccgcttattaacacgctattatcttacacgaaaggttcgcaatctgctgctcccctgcctttgcgtgaaaaacttttacagcatatgccgcatcgttttctgcgtatccctgtatcccattttttcatatagtccttccgcagaaaaattgcctgccaggactccgagctctatgtattccagtcctctttttatggcccaggcttccgcctccttgagcaaactggtcccgatgccttttccacggtgcttttcatcaactgccaaatccatgatacaggcaaaacgatgcggaatgaagcactcatagggcggcgcggacttttgctggaccaaaagaaagccaaccattttctcttcctcccaggcggtaaggatatctgcttcttcgctttccatattcattcgtataaatgattcctcctgagaacccggacggataaattccggctggatttccgccatcgcggcaaaaagctgcctgtaaagttcttcaatctccggaatatcctcagctgctgcaatcctgattttcatactgctctcctcctgtcatttctatattgttaaaatttttggaatcggttggaataagtataaactgaattactcctgaaaacaagtaattgctactgaaagcagccctgaaagcagcctcattccatggaaagccctgtgcaatagcctaaaaaatacacagtttcccggatgcaaggtagattatcggcagactgtatgttaaaatatatcataaatatttttcaaaaaccgataatcaaaggaggtgttctccataaaattccgtacaaagctttttcgtgcaaaggatccttttgacacggaaagtaccaatgctgtttttttccgggcagtgaaggaaaactgcctgtttcaatatgataactgcaaagagtaccgttccattctggattattatggtgtaaagccggaatcactctgcagttatgaggatatcgcaaagataccttttttgccgaccctgcttttcaaacatcataaactgttttccgtccccacccggaaaatgctcatacgtgcaacctcttccggcacgaagggggtattcagtgaaatcggctacgatacaggcggtttattctgcgccttaaaaatggtgctgaaaataggcgggctccgccatctcttttcacctgtcccctgccattacgtggttttcggctataagccccataaaggcaaccggacagctgttaccaaaacagcattcggggcgactctgttcgccccggcaataagccgttccttcgccctgaaatatcaggatggagcttatacccctgatttagaggctatgatccgggccattcaaaagcacagcagttcccgttttcccttacgatttatgggctttccttcctatacttattttgtcctgcagatgatggatgaacgggggatccgtctgaagctgaaaaaaggttccaaaattatgctgggaggcggctggaagcagttttatacccagcaggttgataaaaaaaccttttatgaactggcgtacagggtactgggaatcggggatgaagatatcgtggaattttttggtgcggcggagcatcccattctttattgtgactgtaaaaaccatcatttccatgtacccgcctacagccgcgtcatcataagggacgtaaatacccttcagccgcttgaaaacggaaaaaccgggctgatcaacctgataacgcccatgataaaagccactcccatactcagcgttatgacggatgatttgggtgttctgcatgacggaagcgaatgcggctgcggaatccattccccttatctggaggtcatcggacgtgtcgggctgaaggatatcaaaacctgtgctgccggagcggcggatcttatttcggagataaaattatgatactggctaaaggaaagctttatgattccagggaacagggacgcatcctgtccggtatggaagaagaaatcaatcatactcttgcagagaaaacgctgtctgcagatacggtcattaccgcaattgatgctcttggcaaaaagattgcggacggtgtatttgatgcaaaaatcgcagggcttgccatggacggcgctgaacggtacaaatcccttgcctccgtcatcctgagccgggaaaacatagaatataaactccatatggagctgggtgaggatttttttgtcccgttcaggacaaagcctccccatgatcagaaaagtatctgtgtccgcgccatgcccttaggcacccttctgcacatagccgcagggaacgttgacggtctgccggccttcagccttgcggaagggctgctgacaggaaacataaacatagtgaagctgcctcaggccgatgacggcctttccctcatgatcattacaacccttatcgaaatcgagcctgccctcagtgacttcatctatgttttcgataccccttccgacgatttgcccgccatgaaaaggatggccgatatggcagacggaattgtggtatggggcggagacgccgccgtttccgcagtaaggcagtttgcgcctgccggggcgaagctgatcgaatggggacacaagcttggattcgcgtatatttccggttaccaggataaggaacgggaattgaaagccctggcggaacatatctcatccaccaaacagcttttatgcagctcctgccagactatttttctggatacccacagccttgaggagttgcatcatttctgtgaagatttcctgccttatctggaaaccgctgtctcacaatatccctctcccagcctgggaggcaccgccgaaattacgctcctgaaatacacggataccctggaaaaaatcctgtggggtacacaggaagccgatacagcagatttccgtgcagatggctgcagcctgaccgcctgccgggacagtgagcttgagctctcctatatgttcggcaactgctatgtaaaaaggctgccaaaggaaaatatcatatccaccttgcggaggaaaaaaggatatctgcagactgccggactgatttgtcctgccgggaaacgggaggaactgaccggactgctggccagagccggtgtggtgcggattaccggcgcaggaaacatgtcggaagatttctgcggggaggctcatgacggagtttatccgctcagacggtatacacgcattgttaatatagaataaaactgacaggccgcttacttctgcggcctgtcagttttattcttatgctgttttctgattatcagagccgtcgccgcagctgcaagaatcagaagtgctgttagcaaatataccggcgtatagtttatttttcccgcaataaaaatactcgtggggccatccgctccgccgattatagatattgcagaggccttcttccgccagccaagcacactcgctataatacccagcacactgcatgcagataatacccagaaaagtatttttgttccttttttcatatgtatatatctctccttctacctcagctgtccgcttttgatattcttcctactactgaacagctggaaaatactgcttgaccagttctttcacttccacacagccccgtctgtctttaccgaaaaacccaaaacacgcatcaggttataataaatcatctcctgcaccttgtccgccggatgaaggccgtcatttctgcagcccttcccaaatataatatcatcaatctttttccccgtgaagaaaagataatccataatataattatagttatccactataaggatatcttccgcctctgccacatcaataatagtattggcaacgtcctccaaatgataaagcctgtttttataggattcattctctgcggtagacggattaggggtaaacagtacgactggcttatttttttccttaaaataacgtatcatccaggtaaggttgctgcgcagctcatccattccatttacccttttacgatcgttcgcccctaaaaataaaaatataatatcatccttatcttcctgaaaaacagagggtaaatgattcttcagctgaaaggaaaaagcgcctccgcacccgttattcaccaccgtacagcccgggtatttatcatcaatatagttttgaaaacggctccaccagctgtttggcgcagcacgcctcacaaaaacatcgtccccgtcatgcagtatcacttcctccgtgctatagctgtcagaactgcccgcgcctgcagccaggctgtctccaatgatattaatctgcgctccctgtctgatcagtcccctgatcaccgctctgtcattcatttttccctccgatatccgttctaatgcgcccgcagatcccaatcctgaaaaggaaaaccgctgctgccccaggaatacacaatatagtatttttcatctttctttttctcccccggaatggaaaattcctcccggccttccagcggccctatcccggtaccttcctggcgttccacaataaaatgccatttatcctcccgatacggcaaatagtaatcctccagttcttccatcgtccattcactccggagaaggagcgccgcaaagtactgcattttattcccgtttccaaccagattccctgccaggaaacggctgtcgcacacaacagcgccttccggcaaaggaacctgaaccatttccttatacagcttctttgctatatggtcattcactgccggagcaatgataaatgagagaaggaaatacaaagcaatgattcccgggagcaaactcattattatgattcccattacttttccagcttttttcatcttttctcccattgatttcctcagcagatgatttcgatcacctgctccaccgtaagcttcagttcatccggaatatcttccctgtgggaaaaaagaaccatatattcctctttttcttcatcttccatggcagcgctgatattctgcaggtgcagcctttccccaatcctgcgcaccagttcatgatgtatgatgcagtcatccgttcccacatgaaaaattcccgccgccccggtattcacaatatgggatacataccccgctatctgctcatccgtcgcaatattgatatacagctttgtccagacctgcacctgtccttcgcctgcggcgccggcatacaggctgcggattctcgggcagtctctgccccataccatgggcaggcgcaggatcatgcagcgctctcccaattcctgcataagcatggactcacattccaccttaaaccttccgtattcactttctgcccccggcgcatcctcttcataatggggtctttccccatccttatcgaatacattggcggtggaaatataacataaccggctgttcggaagcttcttcatttcctttgccagctgtctgtgaaaagcaagctgatcggcaaactctccccgaaggcttgatataatccattccggctcagtcttttgtaaaagaatcgccggggccagcggatctctgacatccaaaaattccatcctggtttctgtttcataggcagctttgctatgaaaataggttccatataccgtattttcccgttccaatcgtttttttatcgcagccccgacaaaaccgctggctcctaataccagaatatttcccatctttttactccatttcattcaggcaggcctgaagcaggtccgcaaatctggctatatgaatgccgtccacaaaggaatgatgtacctgtacggaaaaaggcaggatcatttttccatcccgttcgaaatatttcccccagtcgaacagcggggtagccgcttcgttgttcccggaataagtatgggaaacatgggtaaaagaaatccagggcatgccggagaactgaaaaagatcatttcccatgggcccggtaaaatattccttctgtgcgctgactgtctcttcagccgccttcacatattcttccagcgaatccttcatgggtacgttaaccactttaaacagctccgccccctcgtccatataagtaaaggaagtgtcaatccgatcaaacagcactacctctccatcctggaaacggtatcggaattcttcgcattcattcgcacatttggaaacaatatatacgaaggaaaaagtgaaggaatagcccttttctctgattattttcaggaaatttgttatatccagttcgaagctgactccatactggggctgcatgctttttctgaatacctcgcagtgaatggctctcttccagttcttcaggtcaattattttataagccgacattcgtttattctccttctctcattcctaatttcctgcattgctccccggcggtcacagcaggatatttctttccagccatccggccacaccatcccgatcattgtctgcgcagatttcatccgcggcttcttttacctctgagatggcattttcaaccgcaataccccttccgcattcccgcagcatccggatatcattataatcatccccaaaggctgcgatctcttccgtgctgatgtgataatgggcggcaagcgtcttcacgccgttcattttacaggcctgcttattcattaccatagcgactgcgttttcggaaagctgtatataaagatcgggcgtaagaaacagcttgaacttctccatttcttccaatgatgtggcttccagaagaattttatcggcgggcgcttcaggcagatctgtaaaatccgtaaatgtatatgggatatccttccatatgttacccggattaaaattggcatacagacaatcctgtatctcggcggacacatgaagaccgggaaatgcctccagaagagggaaaatacatttttccggattgggaattccatatccgtcaagcattttttctcccagccttaccacagcgccattatgataaatggcggcatcacaggagagaaagggcagaaaactcttcacagccctcaccggacgcgctgttgctatcacaaaaacaatgcctttttctctgcattgccgaatgatttgctgagaatatgccgacacacttttatctgttctcagaaaagtaccatccaaatccgtcactatcattttaatatccatgtttcctatcccccgtaacagatattttcagtcatctaaatgaatggcatcccctcttacctgttccctgcggcatattctccaggattcacatccaacaccacacgcatgggagccgccatggcatcctccctccggcacacccatttttcatggtgaatcccttctaccgtattgccgtcttcaataatatcaccgtattcaaaaagataagccgccagatttctgagaaaaatcactacctcattgggttccaggttccggcagtggaactgaagatcaggaagccctatgggagtgagtccaagagtatcaaaaaggagctcgtccgtgccgcttatggtaaagaaacggacattgaggccgccgtcaaggaaatgaagttcctcccggttccaggaaggcttcaaataggtttccctcggcaccagattctgactgtgaggccagtaaattccgatgcattcaggaaaaagctccagtatagcgtcagcataagaagccagaatgccatattgctccatagctggcagaccggctgccagcatattgcttgccattatagaatagcggcatttttccagaaatccatccttgtccgggcaggcccagaactgggcttttacatattcatcaaattgtttgctgtcgaactcgtccgctccgtaaatcatcagctgagagggcagatcctgattctccttgctgtagtgaaccagatgatcccacagcacaaaggacttcagtcctgcagggtcttccggcattttttgttcctccgacagttcggtcactcttccgaatttttcggaaagcttgctgcagaattcttccgcagtgggcataactatcggtttttcaaacaaggggataaagaaatataccgaagaccacttatcaacgaatgcatttttgttattttccataattgttttcctttctgtcttgctgttcagtcattcttcactcgattccgggaaacgaattcctatctctttttcttttctccactccggcacagggccgtcatctccccaatattcatcaaccgcacctattttatccccatccatccggataaaggatacgacatgaaaagacagggaatcatcctttgtgtggacgtgaacagccattatgttgagatctcccgccttttccagccgttccacttctcccgcccattctccgggatattcgcagttggcacggataaattcattcacggtaaattgttcccgggtattatgccatcggatgcacgcatcttctttgaaaaaataaggcaactcatccgcctgctgttccagaatggctctccagtatttctccaggaattcttctttgtcgaaagccttcatctccggttctccttcctgcttaccaccactgtttcagaatctcttttgtcttcattccgttcttcttcacggcctgtctccagccgaattccgcagcagctttgtaggcaaatctgggaaaatccatctggacaaagactgtttctccggctctttgtgcggtgctgtcctctgcaagacggcaaagcacttttccaagggatgcgcccggcccgcggcccgcagtcacattggcaagcgcagagaccattccgccgcctccggccccgattccgtatccccactccaaaccgctgcggcagcaccagttttccatcatctgaatggacacggcattctggcagccttcataaaaaccacagttaattatggcataaactgtccgctttttctttttctcccggattaccgtctccaaatccagcaaggcgctgaccatatgtgaggggattccgtccacgtacaaggggaaggcaaaaatcaggacatcactgtctgctgcctcctgcagctgttccggctgcgggtgcggggtaaaaaaatgcagttcacaaagagaagcatcgcttttcatatatccttttaattgggataaaatcactccggaagcgctgtccctgcgtttcgggcttccgtttatcaatgtaattttcatacaagccctcctgcttcttccggattgcggcagaaagcgacctgttttacctcacagtacagattatctgccattgcatccacccattcccgtgcggtttctttctcctgctccgtaagatcttctccgtaaaaaacaactcttaatgccaatgttttccgatatctctgacgatgatgcatttccccgttttttaaaacaaaataggggaggatataggatatgctcctgtccagtacattcttaacaaaagggccggggcctccgaagcagcagcggcttatcagtataatttccccgctgcctgccagcagcctgcccatttcattgtatttatccttgaggatgcattttcccggcgttttgagccagcagccaaaacagcctatacaggactttatagaaccatcgtcacaaatttcaattatattttcatcctttactgcggacattgctccggcgggcaggtcatgaataaccagcctcttctcgtgttgtctcaattcttctttcatgctgatacctttcatccgctcagataaaaacggcctatccttccagtttttttctcaggtcttccatatactgcttttgctggtttctaagatagattcccacaaacggcttcatccagaatttttttgccttcacattttcagtgaaatccgccctggcgcctgccgttattttctcaaaggttccaatccagtgtccctgcatattttcattttccatgtcaaattcgtatctttccataggctcataagccgttatggtaaacgtggtggcaaatccgtcttttgtgtattcccggaatttcatgcctgtatgtatcgggcttttggcacccgcagaaccggaattttccggttccagtatttctatcctgtcaagatcacttctccatgcataatcctccagactggttaccgcttcccatacggtttccatatctgaatggaacacttcttttctgtttgctgatgccatctcttcctccttctgcctctgccggcgctttctctatcaggtatccgtggatacattgtcccagtcatcgtcgtatcctatcagccagtttaaagccatatgccgctccaccacaacatccgcattgagggacgcgggtgcttcgtttccttttattctggcatccacacaggcccagtccaaacggtaaatcaaatccgcctcgtccagtatttcctgtatgccccgcggtttggcggcctgcagcagaagggacagctccggtctgtcacgtacgatttcaatcgctctgtcacaatcacagacctcttccggatagtccagttcttctataaaacccagggcccaggcaagcacccaataggcctcatatttccaggtcatggcacataattcttcctctgatgcgctgccggaaaatatgtgcttctctttttccgtgagttcctcaagcgcctcataatcctccagcatcgcaaaccagaaatttcttccttcctctccgccgttcccctgcatgatatcgaaggaatactgtatggtaagcaaggtgcataccatgcgtttggctattacctccggcgcctttatctttacagacgcggaatcttcaatcatcggaagatgttctatataaggtacttccttctttttcaggaacgcaatggatttttcttttcgcagttccccttctgttttcttatctaaaagcataatttccattcctccatccaaactgacagtgccgcaatgtataaataacatatgcaggattcactgttttttatcaattatcacataactgcaaaatacgcagcagttcctctaaagctgtaatctcataatccggattcactccgcagacggcggaacccttccccggatgataccagcaggtcttcattcccgctgccgctgccccttccatatcgttaaccagggaatcccctaccatcaaacactccgatgggcttgcgacagacagcgtattacaaatacagtcaaaaaattctgcggaaggctttaccgcacccacactttctgaaacaaaaatatggcttatgcagtctccaaatatagcggctctgggtacctggatttcctccagtccatttgtagcgagaaccagcgtataatattgtgacagacgcccgcatacctcttccgctttcggttccggaatcctttcttccttataataccgggtgtaaatccggcttaattcttccggtgttttctccaaattcagttctttcttcaactcagcaaaacgccgtaccgcatagctccggtataattgatgataatttttccgtatataaggatctttcgtattatcaagatcgtattcctcccaaacggagtcacaaatatccgtatactttctatgcagctcatcgtcatcgaagataccgcacgactccattgtcctgctgaaagctctgcgctcagacttttcaaagtttataagcgttccgtccacatcaaaaataatataggtataatccgtcattttcctttcctgttcccgccgggtaaaaaacaatcgtggagcagcactttccttctttgaaaggaagccttccccacgatcgtcccggtcggaaggctgcatttttcatgtcttccgccggacctttctgttattttttcaaaccgctctttttatcatcggcaatcagcttacgaagcgcttcttttcctgtgcggatagcggcgtccgtatcatgctccaccggattggttaatccggccttttccctctcctgattggcaaccaccagaaatacagagccgcagcgcactctcagataatccgcaacaacaaacagcgccgccgattccatttccgatgccttacagcccagcctcagccacgcctgccacttattctccagttcatagctaaccggcatgatttccggttcatgctgtccataaaaagaatccttacactgtacgatccccttgtgccagtcatgtccgctttccttagccgctgcgatcagggcattcaccacatcaatatccgcgaccgcaggaaactcaatgggggcatattccctgctggttccttcatttcttatagcccccgtagcgataaccaggtcgccgctcttcacatcaatatccataccgccgcaggttcctaccctgacgaaggtatctgccccggccttaacaagctcctccatggcaatggaagccgacgggcctccgatgccggttgaagttacgctcacccgttccccgtcaagcaggccggtataggtaacaaattcccggctgtccgcaacaagacacggtgactcaaaataccgggcaatcttctcactgcgcttgggatctcccggtaaaataacatatcttcccacatccccgctctttatctgtaaatgatactgtattccattttccgtatatttcatactttcctgcacccctttccgccgcctttttggttattgacacaagtataccaaaaaaagggaagggaatacagtgttatctgcgtaaaagaatcttaatttttgttgtaatattatattttccctttcgcagaaggcctgcctttcctgtctatttgctttgattaatatggcaatccgtaaattccgtggctgccgcgtcacaaacaatggaaaaacttgtctgatgattgatatgggcattttccaaaattaaatttctgataacggctccttcacttgcggcaaaaaagcccatatcaccggacttttccgttattgtgagattgtatatcttatacccattgccgtcaaatataccggtaaaaggatccttcttactcccaatcggcttccattcctccatcagggtaatgtcactgcctaatatataattttccgacagggaatgggttttcccgatggaaagcaattcatcctctgtggttatcatataatatgttacatcttctatggtggttgtctgcattgtatccgggagctcctctgctgattgaatcgctgcggcggtatcgggctttgcattgcagccgcttaaaataaatatgaggcaaattaatactggtattagctttttcatttaatcttctcctggcctatattctttttttcatgataacatataaatcctaaattctcaatttacatcggcattgacggaaggctatccaatcattcccggattttcctttcgccctgctgtcccattctgtttcatcagggaaaaaacgccagggtatatttattgtaatgctttaggggtatagaaaagcaccacaatcctgaaggactgaggtgctcttcttttaggctgggaagctgttatctgacggtaaagctgcaacttcccggcctatgctatcatatgatcaagagttactggcccgtacggatcgatttaacagacggggcgggcttattattttcatggcaaaaccggctcccctcatcgttctatctccggtctcccgctgcggaggggtcaataacgatttctacaaagcgccgcaggatggcggctgcctcggcacgggtaacggtatctttcggggcaaacaggtggtttcccttactgttcatcacgcctgcctgctgcatggcctgtaccgcgcttttcatgctgccggcgatcttgttgttatccgtaaatatctctgcttcgcgggctatcggaagggtataccccagaacagccgcatactgtttcatcatgaccgctatctcttcccgggtgacagcggcatccggcgcaaaggtcttttctccggtactaataatccccttggaggatgcccattctacgtaaggggcattgtaagcggcggcgtcagcatcggaaaactggccggaaggataggcagtaggttcgataccggccaactgtcccaacgccagaacgagcataccctgcgtcataataccatccgggataaaagcagtttcaccagttccgcccagcagattccggcttgccacaaagttaatgtcttctttcgcccaatggttcacggtatcggcataggtaggggcaggcttgtaacccacaccatagacactgaaatgcccggtggatcctgtcaggttcccgctgctcaggtcatagccggattggtacagccattccgtgttttttccatccttgctgtacacaaggaacaggctgccggtctgctcgtctgctgcaggcttataggccagcctcacagtaacacgcccggcaccaaaactggtaacaaaagccgccttgccatcctggcctgtatagcccacggtaagccggtaagccgggcgggtgcctacagcagccagcatatccccggtaaggccggtttccctggcaacggtcagggtaatatcgccggtggactgcttctgtatttcctgcagggctgcaaggtcaaaggtcagattcacaataggagtatggagagtcaggtactttatgccgttgttcggatcagtaagacggtcgagggtggcacgtttgatgatgatggaaaagctgtcgtaaaccaccgccgaggtcacgctgtattgcattgtaattccatatttctcccggcctttttgcctggcagtatgcagcgccctggtaagggcttcccatgtactgtcgtcacttgccgtcccgatagccatgccgtcctttacagtgaccggtgtttccactacggtccgttccgggctgtccggctgggacggcttaaggggcgtgattgtgatattggaatcgctccctctgggacttgaataatcattatctctattggatatgggtgtattcacggtaacggcacaagtggccgttttctttccatactgggaggtcacggtgatggtcgccgtgcctatggaaacggcagtcaccctaccactgctgtccactatggcaacgccggtattactggatttccagcttaccgccttgtatgaggcatcagtcggtatcactgtggcagccagtgtttcactttggccgggtcccaactgcagcgtattccggtcaaggacaagtgcgcttatgggagtatactccaccgtattcagattctcccaattcccagaatcatagccgtttccgtttttggggatataaaaagtcaggccagtgtttgtattctcgaaagtggaagaaaatatcgtcggcgcggtcgaggattccataataatactgctaaggcctgtacagccgtaaaacgcataagcaccaatttgggtcaggtctttcggtaacgattgcagttcaagtcgctcacagccggcaaacgcagatctcccaatttgcttcaggtctaccggcagtgactgtaatgcaaggctattgcagcctaaaaacgcataatcaccaatttgggtcaggtctttcggcaatgactgcagggcaaggcttgtgcagccttcaaacacagattccccaatttggatcaggtcttctggcagcgattgcagggcaaggctcttacaattcttaaacgcagaatccccaatttgggtcagaccgtccggtaacgattgaagtttaagtcgctcacagccgtaaaacgcataatcaccaatttgggtcaggtctttcggcagcgattgcagggcaaggctattgcagccggcaaacgcataatccccaatttgggtcaggcctttcggcagtaattgcagggcaaggctcgtacagtccttaaacgcagaacccccaatttgtttcagaccgcccggcaacgattgcagtttaaggttactgcacccataaaaagcattcctcccaatttgttccaggttattcaggagggttagcgtttgtagttttgttatcatatgcgaaacagtgtttgtatcattccgcatcgtttttaaattcgtcatgccggacaagtcaagggcagtcagattattccagccactatctctcttataccgctccagcaggtatctccagttatatcctgtaatctccgtcacactgccagtcagcttgatgatagtaatactatcttcttttctgccgttcaaagcagtagctatagcctctttcatttcgttgtcatccatgctaatgccgccacttccattgtcgttaaaggtcacatccaaaacgtcatcctgcacacccaatacgacattagccgccccaatcctcacatagatttctggcagctccacatccttttcacaggtatatccagtcggaagaacgggcgtaaaaagataactgcccaacccggcattgtcatcatattcggtgtcggactcccaaactacatccgttatggtgaccggttccggcacacgttcagcatcattctccaaaggataaccggatgcactaagtgtattgggcaagtccagctcagatagctttgtacctgcagaaacagtctgatattgtgtcttctcacccagcatctcaaaagctgtaaggacaaatactgccgtttcctctgatttttctatgtttgtctccggtaacttctgttcagataaatcgttcccgctcacctgttctgattccttgctgcactctccacagataaaaccgcagatgtggccctctacagtctctttgtatccgcagtcctcatcatgctctccgcgctcatggggacagtccagttcatagcattccttcgtatgttcatggacggcgtcactgtctggtgccggttccatgttctcttcctcataaccacaaaccagcttatccgtataacagtcatccgtgtggatatgttcacagcgatggccctccactgcttccacatagccgcattctgccgtatgctccggatggtgttcgcacaggccctccgtatcggatgccgttccttccgcataaatggttgtccccagctgtcctgccagcaggacagcacacagaagcagcgaaaggccgcgcgcatgtttcctgtttctcatcttgttcctcccttccaatccttttgattcctattgtaaatttatgactttcccgtcttggggcttgtgtttataagcctggaaattgcctgctccatcttttgggtggataccggcttccggcaaaagaacgggacacacagccggtatgcctgctcacggaagtccatatcggaaaaccagaggattcttctgaccaggttccttgcgctggtgatggtgtttaagccttccacgccgtcctgcgccacaatgacggcatccggcagtgcctgctttaccataccgtccagctccggccagtctgcacagcctgttacctgcacttcccttccctgcaaacactgccgggccaggtcaatcagctgttcccgttccgcagcattgccatcgcagacaatcatcttctccatgtatgatctcctttctgccgtgaatttccttatattatcaaaataatatcaatacaattaaatggcaaggagctggccggaacttgcagtttttggccggaaatggcactatggaaacgaactcttctgataaccttttcctgacacgggatttatgcagggatgtgtgaacagataacagccagggtatatttatggtaatgctttggaggacatagataagcgccacaatccccgtgaggactgtgacgctctccttttcttaaaaaccgggaagccgccgttacctgacggtaaagccgcggcttcccaatatattctgccatatgaaccaatatcccggtcctgaccggaccgatctcaagccggtgatgggcctgcttttgccatacagccagcccccggcaccgctctatctgccggctgcggcaggattaataacgatttccacgaaacaccgcaggatggcagctgcctcggctcgggtaacggtatccttcggggcaaacaggcggtttcctttactgcccatcacgcctgcctgctgcatggcacgtaccgcgtctttcatgctgccagtgatcttattgctgtccgtaaaaatctccgcttcacgggaaacgggcaggatgtaccccagcttttctgcataccgctgcatgataactgccatttcttcgcgggttatggaacggtcgggggaaaaggtatccgtgccggttccgttcacaattccctgggataccgcccataccgcatagggagcataaccggcatcggcaggtacatcggaaaaccggtccgaagaagcataagctgccggatctgtccctgcaagccgccctaaagccatgataaacatgccccgtgtgatggcagtatccgggctgaacgtggtgtcactggtgccattcagcataccacggctggctgcaaagtcaatgtccgccttcgcccaatgggtaaccgtgtcggtaaaagccggggctggtttgtatcccacgccataaatgctgaaatgcccggtggaaccaatcacgctgccgctcctcttgtcatagccggactggtaataccacgtcgctctgttgttatcatctccataaacgaggtacaggctcccgtcctgttccccggcagcgggggtataggcaaggcccacagtgactctgcccctgccaaagtcccggacagtggctgccctgccgtcctgccccgtataactcacagtcagctgataggccgggtgggctcccacagccgtccgcatgtcgccgtccagtttttttatccgtgtggccgtcagtgtaatgtcacccgtggattgttccgcaatctcacgcagcgccgctaggtcaaaggtcagatccacaatggaggtgttgataatcaggtacttcaccctgttgtccggattcaccagcctgtcaagggtagcgcggctgataatgatggaaaaaccatcgtaggcctccgctattgtcacgtcatactgtactgcaatcccatattttgtccgtcccttttgtcttgccacgttcagaatccgggtaatggcttccgatgtgctgctgtcgcttgccgtaccggctgctgtgccatcctctacggtgacaggtatttcaatcacagacagcgcaggcatatccggctgtacctgctgcgatggctgtggtgtggggattggagcgggggcagagctgccactattgtctgcgggtgtgcctccggtctcataccctttgaaatttgctgttgccataccgtctgccgacagagggaacagaatgggattcgtgctgccggataccaggcccgcccatccgtcaaaagcttttccgttatccggaacggcagtcagggtcacctgctttgtgtcgatatcgtagcccttattccccgtgtcattgggatccccggttccaaatatgactctgcctccgccgacggattgcatggtcagctttttcccgtccggtgcggtaaaagacgtaaggggtatgttaccgcagcgtaaatcggtcaggttcggcagaccggataaatccagactccctaactgggtattggagcagtacagtgtctccatcccgggatttgagttgcaggacagagtggtcaggttccttaggccggacgcgttcagcaccgtcaactggttacgactgcagtacaactgctccagtttagtcaggtcggtcacatccaacgttcctgtcagctggttattgccgcagcgcagggaggtcagatcctttagtcttctcacatccaggctccctgacagctggttaccggagcagttcaggacgtgcagtttagtcaggttggctacatccagttctcctgacagtaggttaccttcacaaaatagttgggtcaggttcgtcagtttggccacatccaacttcccggacaggttattattggaacagtacagtatttccagctgagtcaggttggacacatccagctcccctgataggtgattagtggagcagttcaggttgatcagctgaattaggttgcccacgtccaactttcctgtcagttcattatcattacaatgcagattctccagctgagtcaggttggacacatccagagtttcagacaattcgttattgtagcagttcaggtgtttcaattgagtcaggttagccacgtccagctttcctgtcaatttattccaggagcagtccaggagggtcagctgagtcaggttggacacatccagttttcccgtcaactggttctcggcgcagtccagggaagtcagattagtcagtccacctacctccaactctcccgtcagcttattatggccacaggccagattggtcaattcagccaatccacttacctccagctttcccttcaggccttttccggttaaaaataatcctgtaattctttttactgtactgtcattccatgttaccagcccatccgcttcccattctttcggggagttccttgtggcaaaaaggccgttgtcgtcaattatatggttgataacttctacgtcgccatcgtggtagccgtcttcgtctgaatcatcaggatcattccccgtaaagaccggggttatatccacgctgccggtcaggtcaaagagaatcgtatttccatttggattcgcgccgacgggtgggttcttccattccttaaaggaaaagccggtgccaggagtagccgtcagggttatcccgctgcggctgaaatcaaatgccgtcatcttcaccgtaccaccctttgtctggttaacattcagggtgccgttctttgtcttgaacgaggtaaaggggttattgtagcattccaaagtggtcaagttcgacaagccagacacgtcaagtgtcttcagctggttatcgacgcagtacagagtgatcaggttcggcaggttggccacatccagtacctccagctgattaaagtcacagcccaacttggtcaggctcgacaggccggacacgtccagctccttcagctggttatcgaagcagttcaggaaatccaaattcgacaggccggacactttcagttcctccagcttgtttgatgcacattccagcatgatcaggttcgtattcttagacacatccaacgccttcaacccggtattgccgcaatacaacctgactagtttcttattctttgacacgtccagtaccacaaactgggtattgtcacattccagatattccaggttctccagctgatccagcccgatcagcgccgtcagcgtattattattaccgcattgcagatcggttagagccgtcaggtcagatatgttcagcgtcccggataggcttttgctgtttagaagcaacttggtaattcttttcgggctgctattgtcccatgctaccaatcccgccgttttccaactttccggcttgctttcatccacgccgctgatattctttaaagtgggatgtgcgttaaggatttcctgaaaagccgtcttatccccggtatcataatcgtccgcagaacttaacaaagcgtagttcaccattccaatccgcacggagatttccggcagctccacgtcctccgcacaggtataaccggctggaagaacaggcctaaaaatatagccgccatcggtggtttcatcccacacgttatcgggttcccaagtcacgtcctgaatggtgatatgatcctccacagtttcatccacggtatagccggaagcttccaatgtggcaggcaggttcaaatcagccagcttcgtaccaacagggacggttctggcctgtaccctctcgttcagcacgtcaaaggccgtgattgtgaataccgctgcatcctccgtttcttcctgttccggctccggcagttccggcacaggcggattgttcccgctgtccgcctccggctctttcccgcattcgtcacagacaaagctgcaggggtggccctccacagcctctttatacccgcaatccgcatcatgctccccacgctcatgggggcagtccaattcatagcattcctgcgtatgttcatgggtggcgtcactgtctgatgtcggctccatgttctcttcctcataaccgcaaatcagttgatccgtataacagccgtccgtgtggacgtgttcacagcgatggccctccaccgcttccacatagccgcattctgccgtatgttccggatggtgttcgcacaggccctccgtatcggatgccgttccttccgcataaatggtagtccccggctgtcctgccagcaggacagcgcacagaagcagcgaaaggccgcgcgcatgtttcctgttcctcatcttgttcctcccttccaatccctttgattcctatcgtaaatttatgactttcccgtcttggggcttgtgtttataagtctggacattgcctgctccatcttttggcgggatacaggctttcggcaaaagaacgggacacacagccggtatgcctgcacacggaagtccatatcggaaaaccagagaattcttctggccaggttccttgcgctggtaacggtgttcaagccttccacgccgtcctgtgccacaatgacagcgtccggcagtgcctgctttaccatgcagtccagctctggccagtctgcacagcctgttacctgcgctgcgcttccctgcaaacactgccgggccaggtcaatcagctgttcccgttccgcagtattaccatcgcagacaatcatcttccacatgtatgatctcctttctgtcgtgaatttccttatattatcaaaataatagtaatataatcagatagcaagaaggtggccggaacttgcagtttttggccggaaattgcattattaaaaccggtttttgagaaaaatggtcttgacagagaatttatgttgagatatgtaagaagggctattcgagaataagacaaaccgggaaatccggaagaaagataagctgatgacacagttatccatcacagacaaccatgtggtttttagctttatcccattaatgaagcaggatgtttctttggaacgttctgctctaatagggatactgtttccgttcattattttattaaaaaagagattgcatttcgcattatcttctgttatagtataaaacaaaatttaaaagcgaggatatatttatgaaattatttatttcactttccaatcgacgcagccgatgaagcttgtatcttttaaggtacaggcttacgtgctgtgtacctgtggaaagtgatttgaatttttcctttcagacactgtcaggtttacacagcctgacggtgttttttatttggaggaaaaaggatgaaattattgacagatttacttacagcaattttcgaaacagcttttttaaactgtggttatgataaaacgcttggaaaggtggttgtttccggtcgtcctgatttatgtcagttccagtgcaacggcgcttttaccggtgcaaaactatataggaaatcaccgttaagcattgcaggcgaagttacagcgctcattaagcctgacggaatgattggcaaaatcgaagtaatggcgcctggttttatcaatattaccgtcgaagacgaatttttattaaactatgccgaacaaatatttcatgacaaatataaagggattccccaggctgaagccccggaaaccatagtccttgattatggcaatcccaatgtagccaaacctctccatgtagggcatctgcgttccgccataatcggcgaagcgctgaaaagaattatcatttccacaggaagaaaagctatcggcgatgttcacctcggtgattggggcttgccaatgggtcttgttctcgcagaattggaagaaagatatgcagacagaattccgccgattaccgctgatttactgaatgaattatatccccttgcaagcaaaaggagcagatcagatgaagctttccttgagaaagcaagaacaataaccgctgaattacaaaaaggcagcatcaaatatatggacacctggcgcaaaatggtttctgtttcggtaagggatatcaggaaaaccttcgacagattacatgtttcattcgattactggtatggagaaagtgattccagtaaatatgtaccgcaactgcttgagatattatccgaaaaaaatttgctcgttcccagtgaaggcgcacaggttgtggatgtttcctgtgaaagtgataaggctcccgttccgcctgccattgtcataaaatcaaatggttctgaaggctatgtgacaacagatatagctacgatccttcagcgacagcaggattttaagcctgacaggatctggtatgtagttgacttcagacagaatctgcattttacgcaggtgttccgtaccacacaaaaggcagagctggttcctgcttcaacagaactgactcatctgtgtttcggaacggtgaacggcaaggacggaaaaccttttaaaacccgtgacggcggaatcatgcagctatctgaactgcttgataccgtggtaaactgttcttatgaaaaactgagaaatacagatgatattgacatgaatttcaaaaaagaaactgcagaaaaaatcggtatagcagcgataaaattcggtgatttaatcaatcattattcgaaggactgcgtgtttgacattgacaaattcatggcatcagagggcaaaacaggtgtttatctgctttatacggttgcccggatcaactccatactcaaaagaattgacagctttgatttaaccgcccctcactcatatggcatttattctcaaagcgagcgggagcttttcctgaagctggccctgagcggtaatgcctttataaacgcctacaatgagaaatcaccaaatatcatctgtgaaaatgtatatcagattgctgtggctttctcaaaattctatcatgaaaatcatattatgagtgaaagtgacggacaaaaaaaggcctcttggctcgctctctgcgtatatacaaaagatatgctgcaaaagcaccttgataccttagcgattgatacggttgaattaatgtaaaacccgtcatattttcagcacccacaaacagccggtataaattttataccggcttaatcaaattttcctcatacagtgtatcgaaagtattgaccgcgccgccatgctcagctatttttccatccaccaccttgtcaatatcaacgccggtgaaggacagtcttttgtgtgtgggctttattccaatccactctccttcatgtgttccttccatgatgaattcagagatcacataatctccgtccgcatattgcttaagtattttcatggtataatcggggtaagttttctttacatcaacaaggtgctgcttcatgccatctatccccacaggtattatctgttccccgactttcacgacacagtcttctgcgataaattgaggaagttcctccaacagattttctgacacaattgtttcatagaaatatttaacaatatcttttttctccatttttattctcctcatggttgcgtgataccgtactgtataccggtgaataccggattataagcataaccggctgaaagttattattgctatactaataaattatgaattccctgtcaaataaaaaaaacaaattatttcaaaacaacaaacgatatatcattgatacttcatattatatccatgtattggcagcaaaaggcccgtgtggtaaaattataggataatacctgacaataaacagaatataaaatacatatattcagaacggaggaatcatgcttactcccaaagaagcggaaaaagaactggaattgggcgctggcttaatgcccggcccctgggtacagcacagtaaatctgttgccgtaaatgctcggctgattgcggagcatacagactgtatggacagtgaatgtgcctattccatggggcttatgcacgatatagggcgcagggaaggcgtcaaggctatcatgcacatcatagacgggtaccgttatatgacaaaactccaccagcccgaaattgccaggatatgtctgactcattcctttcccatacaggatatcaatacctttatcggaaaatatgattgttcggaagaagaaaagaattttctggatcattacctctctgccgttgtctatgacgattatgacaggctgattcagctgtgcgacgccatatccctgccaaacggcgcctgtattatggaaaaaaggctggtggatgtagccctaaggcatggcctgccatcatttaccctcgataaatggaaggcttttatgaatctgaaaaaatactttgatgaattatgtcattgtaatatttattcccttttgccgaatgtgatggaaaattcttacgaaagcctgatataagggccgttgtcggcattactggcctgcaggggaataaacggcatttacataataatacatacgtttatgtctgttatgcaaatccagtgaacaatattccgtatggcggaccttgataatggaaaaattgtgcagaagctttatgatatccgctaagtctgcataaaaatgcggaactcccacttccggttccttttggtaaataaccgtattgccgtcaatcctgtccgcctgtgcctcttggaaatctgttgattcttttgaacagaaggacaggaaaatttcaccatcccttttaagtacccgttctatctcactgattatcatttctaccccctgcgtatccgaatgcgaaactacatggtaggcaaaaacacaatcaaattctttatccggatacggcagatggagcatatctcctgtcactgcttttattggcagcttttcattttccgcccatgaaatcaaatgccggattccataatcggaaatatcgacagcactgacatcaaaaccattttttgcaaaatgaaccgcatggcggcccattcctgttcccagatcgagaagcttgctgtaacccttttctttccatacctgcgacagataataactgtcctccgtaggcttaagccatgccgactgatttgcattttcccaatcccatccctttgattgaaccataattcctcctttacctctcttcaactaaaaatccatccacagcaaaatctttcaaagtaaaactgacattgatcgaaaattcaaagcggagtttattcccattaaaggcaaaacgataaacagcaacatacggtgtttcaatgaaataaatcttcagtataagagcttcgttaaagactgcctcacagtaatatttctgcttatgaacctgcaggtccttcaggaaattcattttcccgctggtttcctgtaaaagtgaaaaacagatagtatcggtatattccgcataacatagcttcaccagatattcattacagaatggaagaaattccacatacttgattcccagaatattatcttccagcctgaaattactacacgggattacagcatccacggcagcagtgtttttttcaggtcttgtattttcgatataggcgcagcagcattctgtatcgttaagcaaatgcttataaattaacgacaacaaggcttccgttttggaatactgggaaaacacaatgacagccttctttttatcagggcacaataaacacagctgaccaaaagcaccatccatacggtaatatccatccttaccgatatgaaattgataaccatatccgtttcccgaaaactcactgtccggattgtttatatcatcctgcttaattatttgctgtgttacggccatcttcagatattcctttgatataagctgactgccgttgtatgagccctcttttaacagcagctgcgctattttgacaagagacatgggatacaggctcagccccattcctcccgccgtcagcttttccggagacagctcccattgagcctcataaatctccatgggataaaataaatactggttcaggaactgttccagagacaggccagacactttcgtgataatggcggacagcatatgggagcaatgggtgctgtacctgtaaaaggttcccggttcatggggaaatgactgtttcagaaaggctttcacccaattatcctgaacaaatagatccgaataggtattttcatgaatcccgcaggacatggtcagcaaatgctgaaccgtaatcctgctcagatttttatccggtgtctccggacactcctccggaaaaaaaccgataataggatcatccatatgcagcagacccaaatcccaggcaattcctattgcaagtcccgaaaaggttttagtcatggagaaaaacagttttagggaatccattttatagggatatctgacatattcccccagcacgctgttctccgaaatatacagggcatgtgtgatattcgtattttcatttttgctgcattcctgtataaaacctgcaaatgacaagacttcatcctcctaactcattataattctttttgttcccattcttttttccgtattcttcattaaaatcgtaggcaatttcatatgtgtcatactcgccaaaccatctcgcatcccccgtgtcaatatcaatattctcagaactcatttatctccgatgacaatacagcctccagaaagctttccggcgcagttcggaagcgcagtcttttataatcttcctccggcatataacgcatcagcaccggcaggctttcctccagtccgttttcccgatatccgattttcttgtccgtaagaaacgcaaaaccaaaatccgtatacagtttgatagctttatagcttgacggctgcgtgtgcagatatacaggaaaatcatttgtttcaagttctgacaacagctttgtaataatagctcttcctattccgctgccttcacatccctttttcaccttaagccagtgcagggtatttatttttccataggacttccaaataaagccggttcctacaggattcccctcaccatccctcacaaacagacactgcgaatagaataaatcttctttttctccatataccttctgaaaataatctgtcatatatccgaaaaacgcttccgcctgttcttcctcgtcgaaaggcattcttttccacaggtcaagctcattcctcctgcatgaatcaaaataatatccttcaggcagacaggcaaaagcttccttcttcggtacctcacaaaccatgaataagttcagatccggaatttcttcgtacattccatactccttttattaccatttcctctgttacctgatacaaaaaagcaggacatcataaacggatcgttttccgtctgacatcctgcatgccgctcttatttgattttccagtctccctgcagcatcatgaacactttccattcctctaaattgcccataacaaagctgtccttgggtacaagaagagacagtttcttctggatcaccaggacatacagattcttggaactgataatcttggtaatcgccgaatactcaaatacggaatgagcgccgttgttggaaaagatttcgagcgcgtcggaataaaagcttattcttctctccagaggttttcctccgttattcgccacctgcttggcaaacttcttatcacgggaggatttataaaggaaaaacggcattaccagacatatgatacctacaagaaggaacacaatgcccgaactgaaggctcctccaaggatgctgaacagtccgagaataatactgaccccgcccatgatataatacagcttgcggtattggcccataaatgctttcacaaattccaggtatacttctttggtgattgtaaattcatttttgaaaaggagctggcctccgatacggtatcctgttcctgcctgatgtatcggcggtattgtcctggtgttttcacccggttcatccgcttccggttcgtttatttcttcttcatctgtcctctgcccgtccgctctctgctgtactgtctcctccagatctgccgcagtatctgctgcttccatatcttctgtttccatagtctcgttcttttgttcttccatttttacctctcattctaccggccataaacagcctgtttctttctgtctgttctgccataaagaaattatgtatgtaaataaaattataatagaaagcctcccggccgtccacctttaattttactttccgatttgtcattttcctatcttccacatactataaaatagaataccataatcggatgggaatgaaaaatgaattctcctaattataatagaaataattcctcctgctgtaattcatgcggttcctgcggctgctcccaatgccggcaggggccgcccggtccacagggcatcccgggggaaagaggtcccagaggagagcaaggacccgccggtctccggggagaacagggaccccagggtttcatcggcccacgaggcaaacagggaccacaaggcccacaagggttgcccggcacacagggcatccccggggccagaggggaacaggggcctcccggaacggcaggctggaaaaatactgcctatgctcaatatggcatcgccgcatctcctcccagccataattatcttccttattatcctgtctggggcgccggtggactcaccagtctgcccactgatgaaaccatacagcttatgcccggatatgtttatatgatttcttttgttttcctggctataccggatgcaggaaactactatcagctcctgccctatcttaatggctcaccccgttttctctattccgtactggcagctgcggggagcggcagaacagcttctgccagcgcctcctttctgaccaatgaagcgctttacgaacctctggatttttcccttttgcttacttaccctgacacggtacgaaatatagatatcaccggagccgtctccatttatcccgtcgccgttctttagccaataaacgggcctgccattcctttttatggatagcaggcccgttttattcctcccaagtgaatggaggattgctcattaaagtctgaagttcattaagattacttccccataacatttgacttaaaaaagttttcacttatataaggtaataagatctttcacatatatttccccatttgtaaattgaattttattattgcttaaaaatccatccagcgattgaattgttttatccataagagaaatcttccattttttgcttaaatcttttttaaagcttatataaatttcattttttaatggttcatatactattgtacaaagtgtattctcctgactggttttatttaaaacttcaaaggcttcatttattccaaagctatcaatattattattactatattcataggcacaaatatatctgtcagcacctattccatgtacttccttataatttgtttctttaaatttcccattcgggaaattagtcataacaataaaatcattatgaataggacttactgcatttgtattacttccttcttccagaataaatgcatcaccagtcttatcggcgataatagtatgtaaccctaaatccgggtatagtggattcctgggatatgcgattactcttttattaaggatttcaaaaaattcagatgctttttttgtttccttcagcgcctcatcaaaagcatcaaaagcaaaccagtcattttcgtcacaacctgctttgaaccccgggccataatctactgcctgagtacatataaaaaggccctcgctgttaaagccagcgatatccctgtatttgttacctgcaaatccggaaaagaaaaataagttcttatccttataactattaaccttcagttttaaatcaatatcatccgtatcaaaattcataccgtaaacaggtttttgctgactgtatactgcaaaacttgtacacattttggaacctccttttgagatatcattatgtcatatacttagaatttcagaaaatcattcagttattttttcatcggcttcaccgctttcctaaactatgtccatatgataccatcatacatttcgatgactccacctataacatttttcagaatcaaaaatgagtctcctttcttaatagcttgccctgtttcctttattccgtataggcagcctcggaaaacaacagaacagtttctgtcagcgcgccgtcctttaaccggcaaacgggcctgccattccttttatggatagcagacccgttttttcttacattatttactttagcctcaattggctattcggaatatttcttcctctttaagagggatctgttcttcctcaatgctgaggatttcaatccacttgcccctcttgattttgtctacaagatgaaggatttctttctgcgttccctgtacctccatctccactctgccatctgacagattagccacccagccggtcaggcccaattccctggccgccatataggccgtatagcgaaagcccactccctgtacctccccggaaaaaatcatatgctttctgatttccatgggtcttcctttccttaccttgcgcacatctgttcttcttcctcagaacttcagattcttgaacaaatcgcccagtgaagtagtggcttcttctttggagctgtactctgccgcctgatgtgcttccatctcatcggcttccgaattttcctccacagcttttatgctgaggcttattttattgtcattggtattcagcaccttgacctttactttatcccctacagtaagaacttcagaaggctttttgattctcttctggctgatctgggaaatgtgaacgagtccgctcaaaccatcaggcaggctgacaaatgcaccgtaaggcatcaggctttccacaactccctccaggatactgcccggaaccagcatggaaatcttatggttgatatcctccacagcacgctctttctcaattaccttggcggagagaaccagcttgttcttttcctcatccacggtaattacccgaacctccagctctcttccgagccagggctccaaatcctcaacataggtcagggacagctgggacgcgggaataaaaccacggatcccttccacaaaagccactgcgccggcctttacgatttcactgatttttacccggatattcttgttctctgccatgtagcctttgagtatatcccaggccagcacctgtaccgcttcttttttggagagctttatatttccttcgccgtcatctgtctttaccacggtagcctctatttcgtcgcctaccttcacatcctcaaggatattaaatccgggatccccgctcatgtcctccgcttttataataccctgagcataatactgcagatccagaaccgcttcctcttcattcaccgcaataacggtacctgtaataatatccccttcttttatggaacggaaggatgcttccagctcctttgcataatcttccatcgtttcccttttctcttccacggtcttgtcccatcctttctgttatttcctttattataaataaaactgactctcttgtcgagtcccggattcagatttcacccctgccatacaagccaaacggcaattaacagattcggggaagcccttctcctatgagttccgtaatgacccgtattccgcccagaggggtggtgagcagtacctttcctctttccttaccggaaatatggccgataatggctgccgcttccccgtatttgcttttctgcatacaggaaagggcgagttcggcgtcttctcctgccacaaccgcggtcattttcccttcgtttcccatatagaggggatccagtcccagcaggccgcagaagccctttacctgatccgataccggaaggcaggactgtgtaagctccacgcagcagtcggaggcagccgcaaattcatgcaggactgtggcgagtccgcctctagtgacatcacgcatagccttgatatgcactcccgcttcctgcatggaacggaccatttctcccaggggagcgcagtcgctcacgatgctgttggttatttccatgcgcacactgagtatggcggcatggtgatctcccaggttcccggaaacgagtacggcatccccttcttcgcagagcgaagcgcttatctgcactccctccgggacaaagccgactccggcagtattgatatagattcctccgctgccttctatcaccttggtatcgcccgccactatcgtcacgccggcctcccgggccgtctgtgccatggacgcggcgatcttttccaattcctcactgtctgcgccctcctccagtatgaaaccgcaggtcagatatttggggcaggccccgctcatgagcaaatcattcacggtgccgcagacggacagctttccgatatcccctcccggaaaaaacagaggatttaccacaaagctgtccgtggttaccgcaagccttccgctccccgctaccacggcggaatcctccatccgggataaaatttcattattaaaatttttttcaaaaatgccggtaatcagctgggaagtcgcccttccgccgctgccgtgcgccattgttattttcatttctattccttttctccgatcatgcggttatttatccccggcttatatactagaagctgatgcttccggaaggatgctgttaaagctgttaaaacagctgccttccgtagaaaccatacaggctccctggggtgtctggggggtgcatacctttccgaacagcggacactgggcgggacgtacttttccggtaagcacttcggcgcagcagcagcccttattcttttccctgtcttccatgagctctctgctgcctgcatcgaaggcttcgtatttcttacgcagtaccattccggaaccgggtatcactcccatcccccgccaggcagcgtccgcaggttcaaaatattcctccaccgcagcctgggctgtcagatttccttctctggtaaccgcgctggtatacatatttaccgtctttcccgctccccgaagcttaaccaaagccgcaatggccgccagtatctgttccccctcgaaacctgccaccacaaaggggatcccgtatttttcagccaggccttcaaatgcccggcttcctgtgataacactcacatggcccggcgcaaggaagccgtcaatgctgttttcccgcttttccccgcagatccagtcaatgaccggaggcataacctttaaggatgtgagcagacgaatatttttaatgccgccggccaatgcatttttcagcagcatggcatacaccggcgtagtggtttcaaagcctaccgccgcaaaaatatacgtgtgccccggatcctcaacggccagcttgagcatatccatgggggaatagaccattctcacctgacagccttccgccctggcttcgctcaggctctggctgctgcccggcacacgcagcatatccccaaaggtaaccacgatattgcccagctccttacccagcaggatcaggcggtcgatgtattccgtcaccgtcacgcagacagggcagcccgggccggaaaccaactgaatagaaggaggaagcagccccggtatcccattgcggctgatttccgccgtatgcgtgccgcagacctccatcagcttcagcgtgcgtccctgatagctctgcagatattcaattatttccttcaccggccgcttcctccaattcctcaaaaagctctgtgagctgctttccttcttcttccgaaagcacctgcaatatacagccggcatgcacaagcacgctgtctcccggttttacgcaaaccaggcccgcctccgcgcgcaccctgtttccctggaaatccaccactgcggtggtcccttctatctcaataacccttccgggcaatgctacacacatatctgacctcctcgatccttctcatccatcagcctttccgctgccagccaggcctgtcccaaagcgatcccgccgtcatttcccggcacctgttcattcacatatacccggaacccctgttcttccagaaggctccggcatctttcctgcagaatcacattggcaaagacaccgccgcttaaagccaccttatcctcatgaaatctttcccggatcctgcggcacatttccagcaccatacaggaaaccgcttcatggaaaccaagagccagggcctccgccctctcttcctctttataccacgtctttgccgctcttgtctcccggaaaattttacgtattacttctttcctgtcagccagaagtatttcttcttcctcccgaatgggaaaggaaaactccggcggggccgcattcttctctatcgcccgggctgccgcattctccagggctatggcacattccccttcgtagctgttgtattccctgattcccagaagtgcgctcaccgcatcaaaaagccgtcccatgctgctgcttttttccgtattaatatgattggaaaccgcagcacggaccattttctctctgagctcctcctcagggcggtcattctctgtttttcccttcgaaagctcacatcctgcatgatagagatggcagagagcggtaagtcctgcatcctttgccgaagcatcgccgccagccagctccgtttcttccagatgccccgcgcggagaaaggaaccgccctcacacagcagaaattcccctccccaaaccgttccgtccgttccatagcctgtaccgtcaaaaacaacggctatgcagcggcgcagtccatgctccgccatcacggatgccgcatgggcatgatgatgctggaaaggaaacagcggcagattcctttcttccgcaaggcgtgccgcctccccggctgtcgcatatcccggatgaagatcgcatgccaccgctccgggtattatcccgaacagcttctccatgtgctccgcagcctgcaggaaggtacggaacaccttgtagctttccatatcgccaaaatactggctcatatatcccctcttccggtaagccaggcagaagcaagctttcaaatcccctcccatggcaagcaccggaaccggacattctcccggaagggcgacaggagccgggacaaagcctctgctccgccgcagaagctgaggccgcccacccgttatccgcatcagggaatcatccaggggagtcacaatttttctgtcattccacgcgattccttcaagcagcatcggctgctgcttccaaagctcttccatttcctcatccgaggtcagtataggttcatccgtcacattgccgctggtcatcaccagaggcccggcggcttcggtaagcatctgatgcagccccgtataaggaagaaaggctcccaggaaccggctttctccgctcactcccgatgcaaagccgtacctgccctttttcagattcagaagcacaatcggccgggccggtgaaagaagcagtgcttcctcctgttccgaaaccatacacacctcacggatgctttccatggaaggaaacataacggcaaagggctttttgtccctgtgcttgagctgccgaagccgatccacggaatctgcattatccggacggcaggaaaactgatagccgccgattcccttcagggctatcaccccgcctctttgcaaaacagacagggcctcctccagcgcctcttccttttccctgtatacaacagcgccttcatccccccgggccttccagcaaagctgagggccgcagtcatgacaggatatggtctgtgcatggcggcgccggtttcccatctgtacatactcttttctgcaggagggacacatggcaaattccctcatggtgatatgatccctgtcgtaagggaccgcctccataatactgtagcgggggccgcagtttacgcagctgataaaaggataatggtatctgctgtctcccggctttttcatttccgcaagacattcttcacaaaccggcagatccggcggaagaagagggagatccgcacgattctcctcctcgctttccacaatccggaaatcagaaggacagggatcttccttttctgccctctccgcctggacccggtccactctggccgccggaggtgcatacgaacgaaggcgacagataaagttatccatcgcctccgcatctccaaacgcatctatccttaccactccgccgctgttgcggacacttcctttgatatgaagttgttcagccagggctgccacaaagggccggtaaccgactccctgtaccacgcccagaatggtaatttcatatctcatgtatgctcctgccccgctgtctgtgccgcttccggctttgcggcaggctgagcagcttccgctttagccgcaggctttgccgcttcctgtccggctgcgggctgagccgccggtttcacagcgggctttgccgcaggttccggcatattagtcttaataaagctgtccgtcttcttcgttccatccggctcagtatagctctgcttcatggacagacatttcttcgggcaggtttccacgcagcacccgcactggatgcagccgaatctttcgatttcccacagcttggcggccctgtccacggtaatggcccccgtggggcatttccgggcgcagaggctgcagagtacgcatgtatctatatcgacttccacatgccctctcgtcctgtcgggatactcccttggctgctccggatacggtcttgttgcaggcttgctgaacaggttcttcaaagccacgcttgtaaatttcattgtgttcatttgcttcattgtattacgctccttccccttcgtcagcgttctgtacaactgatgcagggatcgattgtcagaatcagaatcggcacatctgccagctgacagcccttcagcgtctcaagcaaagcgggcagattcgcaaaggtaggggtacgtacccggaaacggtcgataaacttcgtaccgttagccttcacataataaatcgcctctcctctgggctgttcctctctcatgaagtattctccatccgggaagcccttgaaaggaaccgccacttctccgccggggattctggaaattgcctgacgtatcaaatcaatagactggaaaatttcacggatacgcacgtcacatctggcataacagtctcccaccgtactggtgatcggctcaaagttcagatctgcatatgccgcataacccagcttcctgttatccagggcgataccgctggcccgcatgaacggccctaccgcgcccagatcatgggcctgctcttttgtaaggaagccaacatcacgaagacggctgttcacggccgtatcctccaggaaggttctggccaccaccttcagctccttctcaatatccgtaaaatccgccacgaactgccggagcatggaagcatccatatccttgcgctgtccgccgattttatttacggaaaaaataaccctgccgcctgtggatgcttcaaacatatccagaaccttttccctgattttccaggactgcatgaagaggctctcaaaaccaaaagcatctgcgagaagacccagccagagcagatggctgtggattcttgacatttcacaccatatggtgcgcaggtaataggctctgggcggaagctcaatattcataatgtgttccacagcctcgcaatagcccatgccatgcatgaaactgcagattccgcatatacgttccgctacatatacatactcggtaaattcttttttctcgaccagtttttccagtcctctgtgtacgaagccgatggaaggtatcgcctccacgactttttcatcctctaaaaccaaatccagatgaatcggctccggcagtaccggatgctgcggtccaaatggaatcgtgctgcgtgtggacataatctattctccttgtatcaatgcgattatactactctttaaaaggtgcttccttcttaatacggtacaggtttccatggtaatccaatgaaatcatcttaatattgatgccgaacagatcatgaatttcattttcatataaaaaggcaggcgcataaatatcactgatgctcacaatttctgtatcgggcagtatgctgatccttagccccaccatcttatattctttaccgaaggaataggttatttctatcctgtcccccgcttttgccgcacaaatctgtataatcctgtaatccctgtgcttcagcatcaggacctcggtaaccagattttccggttccacctgcatgatttcgccgtcgatcatttcgctcctccttccggtttttcctgtccgttatccgccgtcttatgggaagctgcttccgctctcttcttatccagcagagcgacagcctttaccacgccatcaataatcgcttccggacgggccgcacagccgggcacatagatatccaccggaatagtggtatccacaccgcctaaaatattatagcattccttaaatataccgccgttgcaggcgcatattcccactgccaccaccactttgggagaaggcatctgggaataaagctgctgtaccacaggcttattctgttcgttgatgcctccggtaatcaggaaaatatccgcatgcttgggatttcccgtattaataaccccgaaccgctccacgtcatagaccggagtcaggcaggccagcacttctatatcacatccattgcagctggagccgtcataatgcagcagccagggtgattttgatattttcattttcattccttcctttccggttcccgctatttcatcagcatgacgatcatcaggttaatcccgcctgccgccagcgtaacaatccaggtccatttcagcatgatctgccattttaccctggggaatgtattatcaatcaaagtttccagaaggaacgcgagcaaacagactacaatagccgccggaatgctccaccagctggaattgatgataaaaagccccacaacacccaaaaggaatacattttcataccagtgggataaggtaaccagagccaggatattaccggaaagctctgttgtcatacctcttaccatctcctgatgcgcatggtgtgaggtactgatatcaaaaggcgactttctgaatttaatagtcaggatataaaggaaaccaatgaaaaatccgggcagaaggacaatcgccgaaacattgctctgggcgatctcctttatggaaaagcttcctgtcgctatataaaatccgatagcggtaagcagcaccataggctcataagccatcatctgcatcaattccctctgggcgcccatggaactgtacggcgcattcgccgaacaggccgacatgataaagaagatccctgccagagtcagtgcaaagaacaccagcagaatatctccgccccagaaaaacagagcccctgtaaatactacgaataccaggaaaccgcataccaggaaatcctgtacactgtttaccacaacagactgcttggcaaacaatttattaagatcataaaaaggctgcagcaaggaaggccctttccttccctgcatacgggccgacaccttacggtcaattccttccagaaggcctcccgcaaaaggtgcaccgataatatacaaaagagccaggaaaaaatattttgacatcagagcgcacctcctatcgtcataatcataagaataatcagcgctcccgcagccagcaccatagatggcagaagaagcttgttttccccgaaataatcgggcatataccagttagccaggtacatgtgcttttcttccccgaaggaatctgtgaagtttctgtcatcaccggcattcgcaccgcccatgtaggacataaccagcttatttttcttgcccagcgtaagtacacgaaccgctatcggcaggatcagaatcgtacacagcatcataatcatgatgtaaagattgccggttccgatcaggttaggcacatactgatgatacatatccatcaggaaaggctcaatcaaatatgtggataccaacgggaaggtcaggcacagggcaaccatgatcacacttaaggaaatcagggaagtccattcgctcttcttcgtcacattggtaagctgctccgaatgatggtggaccgccaccagtgatcccagccatttggtccagtaaaataaggtagtcgcactgccgaataccaggaaaataacaagaagaatgcttcctgaatccacataagccttcagcgccgcccacttggaaatcagcattccgaagggggcaaggaacatacccgctataccgataatcattacataagccaggccgggcagcttgacaatcagcccgtgcatgtcttcaatattcctgcttcccgtacagttttccaccgcgcctacggaaaggaacataagggatttggatacggcatggaacatcatcagaaggatggccgcccataccgcctcatgcatacccacaccggcacaggctgtaatcagccccagattggatattgtggaatatgccagaaccttctttccgtcatcctgggaaatcgccagcatagaggtcaccaggaaagtaaagccgccgatagtcgttaccatcgtaccggccagattgccctccatggccggagccagacggatcagcagatatacgcctgccttaaccatcgttgcggaatgcagaagcgcactggtaggcgtaggcgccaccatcgccccgagaagccagcctgaaaaaggaagctgcgcactcttggtcagtcctgcaaacgccaggaaaacaaccggtatcaatgccagccccgccttcgcgtccgagctgacggcgagagccacaagatcctgaatattaatgacctgaagggaaattgccgcataggcaatagccactgcaaagccgaggccgcccagcaggttcatccacaaagccttaaaggaattctccattgcttcatccgtctggttatatccgatcaggaggaaggagcagatgcttgtaatctcccagaagaaataaatccaaatcagattactggagaagatgagtcccatcatggcccccaggaacaaaaacagcatcccgaaaaagaaataccgtctgtccttataatccagatgatgcctgttatagtccttcatataaccaagggcatatacacagatcaaacagcctacaataccgatgatcaggctcatggctatggtaagcttgtccgcataaatatgatttccgggaatttccgtacggccggtaagctccagccaggtcatcagtcccgtctgtactatggacagcaaagcacagtaatactttctgaatttaaagctgtaataaaatacaagaactaccagtccccattccacaaccagcatcagcatatcgataccgtgtgtgtgaggcaggtaagaaacggtttcccctgaaatcaggctggttaccgcaaaataaatgactgccgctactaagatcccgcagagagtaaactgaacacttcttctgatcagtccgctctttctcatgcatgacataataagtgcagcaaagaaaggaaacagaattaaaaaacctatgattcccatatggaatttcccccgctttcgccttattggacttttactcaggcttataggtgggtagtacgtgtgcgggacggtgatacatgtccggacgtattgctcatctaaaaaagtttgaatcagcccttatccatcctacttctcttgtccgaaagtgtcaagtgacaagtatgaaaaaattgtagaaagaaaatccaattcatattattgtgtggtataatatatacagcaaattaatttaccggatttacggccggcaggaaatctgcgttcaccgcatgattccgcataatgtaaaggaggtttccttatgaaatgtctgttcagctgcgctaatcaatatgttaaagaatctgactggaaggattttgccctcgttaagctctgtctgtgcgccataggcgtcatgatcgggctggctattccgaaaaagaaaaagaagatgcccttgctgatcgctgcccttgtatttattgccacctatattcctcttatgacaaagtttctcaggattgttttccgcaaggaggacgatgccgcctgtgaatgtgaataagcgatctgtaaaaccggccctgcatacttgctgcagagccggttttcttataaattaatcaatccgcttattttaccggaaagactctcggagccgccagaacgcccatgcgtttcagctgatattcgtagctgaagcccgctcctgttgttctccaggcattggggcctacccaatgttcatattcattgcaggcatgcactgttccgaacgcattcaccctgtttccataagaaataatggtgacggcatgctttcctttttccagatgccccagctgtacctggtaaggggccagggcaatcctgcccgcctgttttccgtcaatcaggactttaagaagaggcgcacggaatttttctgcagcaattatgtactctcctgcttcttccacagtaatttccgtttcatatatcatattgccggcatagaaggggaatccctgatccacataatcgccgaatgcaatctgttccggcagcggagtgagcacagccctgctgcccgtcaccttaacaccgaagcttcccagcagataataccattccacattggtatttctggaataggaaatcttcagaagaagttcggatcttcccaccgggatatgcggcagagccaccttgcggatacattcatccacaaaataaccggaatcctccggcgcatcagcctggcctgcggtgcccgcctgtgaattctttacttcttttccgttcagccaaatggatgtggcgtctgattcctcaagggccaggaatgcatcctccacctcaatttcggaatctatggcaaagcgcagctccagagtatgctccggtgcggatttctcacttgtccagggctgggcaaaggcttccatacgaagagggtaaccggctatttcacggcagacattatccagacgcaggatttcttccctctccatccactctccgccgtcgaaacggtattcagccatatccatcagaagcacgttgggctccgataaccggtaaggcatacgggaagccagatgaagtccttcttccattgtatattctccgtctgcggcgctttccgctgtcttttgactctccgcggcaggggtcagcttaagcaggacgctggaatgatcgtacatattatgtataaagctggttatattatgttttctttccgcggacacagaacgaatttccccggtcatggtatcatactcttccacttcccagctgcctttcaggcggaaggtgatactgtcttttttcggtatgtcgggattctgcatttttctgccgttgcagacaaacagccagcggacatccccatcctcacgcatctggtaaatcagctgttccgaaaggtttcctgctgccgtacgcagctctacatcccggtaagtatccagcgctttgacaagagcgcttctggagaagccgatatggcggcattttccgtaaagctcttttccttcctccgacggccttgcatccacgaggaccggcgcatcccccataaagagcacatccccgccgttctcacgaaagcttttcagcctggaaacggtggtattcctaagtgtttcatttccgggaaccagaactacatcatagctcatttcacccacatggaatttcccgtcttccgatgcttcatactgatcaggcagaagggattccgccacgaaatcaaaatcaagctgggagaagagaagccattccgtcacattggagaaccggctttccagttcttcccggatcagagcggtctgctccttcggtccatagtggagccaatagctttcaatcggatgtactacggccacgcgcacgtgcgcttttcctcttgttagggccgtattaaccctggcaaaatgatcctctatcatgccgtattccttataccagggcgactgatagaaaatggatgcaggataatccctcttggcttctccgttcatgctgtcccaggaaaggtggtgcacacgcaaggtaactccaagagccgcctgccagtctccggccagcttatgtcctcggaaatcaaaatcccagttcgtcacaccataaagttcactgagcacgccggggcagccatactgatgggaagcggactgcgcctgctttgccgtagtatattccctccagtcgcaaagcatgtcaattccgggcatctggaagcttctgtaggaacgcatggcctctcccagcgcattggtctgagatgtcagcgtaggctcttccatcatatgtccggtaagcatgattccatgatctttgcaccagtttccgatggtgtccgcgaaggaggaggaaaactgctccgccacaaagtcatggaaacggtaacggggtaccgataccttttcctccggcagatcccagatgagttccggcaccgtatcgaagaaatttactccgtaggccgcttcataaccggcaggaagactgtctgtataagggagaatgacatcttccctggattccgcaaagctcagtgttgttttatgggaaaactgaggttcatccgtaaaaatggacggaaccgtctttccgaattcatcaccgacacagccgagatactgttcatgggtttcttcaataaaccgctcaatagccctgggattgagtgtatccacataagtttcattattataccacgggctttcccgggcgatttcctcatacaggtaccatacatttgtcccctgctctccatcctcaagacggcggtattccttcaggcagccatcttccagggtgatatcgtagcgggcaagaagctttccgttcccctgtacggcagccttgctggaggaatcaaagccgagctcctctttttgccgttcttcattggaaaacggggtaaacaccagatatctgctgcggtattccacatccttggtaacctttcccccggctgctccggagggccagcgatcctcatcgtacagataggcatacattccctctgcttttgccttttccacacaggcgcggacacattctttgtattcctctcccatatagggcgtgtccaggccggtacggcaatgcatgtggaatcccccgattcccatctctttaaagtaatcgatatgccttaccagcacttccggcgacagagcctggttccacgcccagaacggcgcaccgcggtattcatttgttggattttggaacaattccctggtcaggctttcttctttgcttttctgatacatcattttccttcccttctccttttcttccggtaaagccgcaatttttcattgcattctgcttttaaattctgtaagattatcatagaaaatctacagaaaaagtaaatgggaagaaggaacaaaattgtaattcagaacactgaattgacaaaaagcctgacacaggttaccgccctgcctccaggcctttgtcccgcgcctgccctgtcctccttcggcctgcctggtttctgccgtccctctgtgcggccgcagccctgcatggttccttacagggaaacgactttagtcgttttcgcttaccgctcggataatcacgcagcggtactaaggctgcaaaagacgcagcctaaggaccggcgcgcttataacgccccttacaggaatccatgcagggctgcggccgcacagagggacggcagaaaccaggcaggccgaaggaggacagggcaggcgcgggacaaaggcctggaggcagggcggtaacctgtgtcaggctttccagccggaaaggatattgacagcgatggaaaaagaacggaatgctgaaaacagaatcagtctggagcggattgctccttatgtgcgatatgtgaactataagatttttgatgggggtacgctccttccggaacgtattatttatgaccatgaattcatctactgtctcagcggagaagcccgttttttatatgacggtaaaacctatacggtaaagaaaggggaacttttttatatctgcccttaccttcataataccatgctggttcctgaaggaaaaaccttccgggtccactgcgtacattttgactggatctctccggaagcccaatatgacttccgggcggagcaggtttacctgcatatggaaaacccgccggctgatgcggaaggttccgatgccttctatatgaatagctataaggcaaataatccgtatcataattctcttccgcccataaaagaagaaaggctgctggagcggcctaacccggaggtggatccggccctttttcctcctctgatcacagggctggattacgataccacggcgccgctttttaaggagctttatcagaattattcgcagctgagcaccggcgccaggctgcgcgaacgctctttgttcctgcagctggcggcagccgtatgtgacctgacttcaccggtcagggaggattcctgcgggctgttccaccagaaaaccatcagcgaggccgtgaattatatccaggaatattatacggaagatatttcccttccgctcctggccgctcattccggcctgtcccaaaaatatttcggaaggcttttccgggaacagaccggttatactgtgcgggaatacctgaccggcgtacggatccgcaatgcaaagcacctgctttcccatacggacagcagcctggaacaggtggccttaagtacgggttttcaggataaattttactttaccaaggttttcaaacggcagaccggcatcactcccggaaaatacaggaagtcctatggtcatctggacgaaatgaaacaaggagaacaggcgtttttctggtaacgcctgttctccttgttcacgtacgcccggggaaatacatttccacccggttaaccaggcggcctatgggaggtatttcgcagatcacctcgtctccctgcttcataaaccggggcggattgcttcccatccccacacccgccggggttccggttgcaatgatgtctcccggctcaagggtcatccccttcgataaatcttcgatgattttgggaatgtctgcaaggaaaagcctggtgttggaatcctggcgtttttctccgttcacatagctgcgcacatccacttcaacagggaacggcagggctgacttatgaaggatgaccggccccatggcggtgtaggtatccaggcttttccccctgaaccattgcccgtggcggttctgaagcttccgtgaggatatatcgttgaaaatggaatagccgaagatgtattcctccgccttctccctgggtatgtcctttccttcttttccgatgatgaccgccagttccacctcataatccagctgatcatccaaatcaagcctcgcttcaatcgcttcaccgcttcccaatatgcggatggcgcgtttggcaaaataaacggcttccggagccgctttaaaatcagccagggcccccgccgcttcttccctgtgatccctgtaattcacccccacacagaggatatcatgcacgggccgttcaatcggcgccagcaccttcacctcttccaaagggacctggggacaatccgtctctccgttatacgcctcccaaagctggctgctttcattttcccccgcgccctctatcacctgctgcataatggtaactccaaatcccggatagatccgggacagcggcagtataccggtttcctctttatttaaaatccctatctctgcctttcctgccatttcaaaacgaataaatttcatggctgttcctcccctggactagttttccatttttacattttcagtttacttcccggtatagccggtgtcaacgtaaatgaaaggagttttgagccgatcggatcattccagttccagtaccgccgcatcacagctgccaaggcatatcctgttgcctgccggttttatttccgcgttattgcttaacagcagcttctttatcccggaaggtagctccaatacctgttccccggtaccataatttgccgcaaccaggattttctgttccggcgtgctgcgggtaaaagcgaaaatatctttttcgtcctcaaaagccgggcggaattcgccataggtgaaggcttctctgtaagagtccgatttacgcagcgcgatcagctgcctgtagtattggagtacggaggccgcgtccttctcctcctccgccgcgttgacctgcatatagttgggatttaccttcagccagggctttcctgtggtgaagcccgcgttcctttccccgctccactgcatgggcgtcctgctgttatcacggctgaaacgcgccacggcctccagggcttcttcctccgtcagtcctgcttccagcgctaccttatactgatccttcgtgctgatgtcatcgtattcttcaatactgtcaaacctgcagttggtcattcccagttcctgcccctgatagataaagggaatcccccgaagcagtacgctggtggttcccagcattttgatccccttcggattttgggcataagcaggcagatagcgggacgcgcccctgggctcgtcatggttttcaatgatattggccttaaaacctatcttctgtccttccagctgcgattcaaaaagggccgaacgccattcctcaaagcttacctccctgccagtatgccatcccttatccccttcggaaagaacagccgccgagaaatcaaacatggtggagaaatggccgtcatcaccaatgaattcccgcagctcgtcttccttcatattaaatacctccgcaacagtgaaggcgccgtatttatcaaaggtctccttcttcagttcttccagaagctccccgacgccgtcaacctcttccaccattttggtacagctcaccaggccgtcggcaccgtccgcgggataatccgggaacgcggtgtcctttttgatattaatgatagcgtcaatccgaaagccggcaacccctttttccagccaccagttcaccatgtcgaaaagttctttttttaacctgggattgttccagttcagatccggctgttcctttgcgaacatatgcagataatatttatccgtacccggcaccggttcccaggtgctgccgccgaaataggaacggtaattgctgggttcttttccgtccttccccttccggaaataaaaataatccgcatactcgccttccggatccgccaatgccttttggaaccattcatgcttgtcggagcaatggttgattaccagatccatgatgatatacatacccctctttttcgtctccgccagcagctcgtcgaaatccgccatggtaccgaattccggcgcaatcgcataataatccgatatatcatagccctgatccacaaagggcgactggtatatgggagaaagccagataatatccactcccagttctttcagatagtccagcctgcggatcacgccgcgcagatccccgataccgtctccgttggtatccagaaagcttttggggtaaatctgatatgctactttatcatgccaccatttttttatcattataaaatccctccatattcatgctttctaaagaatagcacggaaacagagggatttcttgcataaaaatatgggaaactaacacgattctaggatctgataaaaatatgtcccatcagcaaaaccaatttttctttcgggaggttccttattgtactcctcccgcattttcaatagcttccgttccgatggtcgccctgtgggcctctccttcattcgaagaaatctggttcttaaacaccagcttaagcaggacaggacagaatatagacgaaagcacgatcagaaaaatcgttgccaccagcggatcgattcctgccagaacgccgttttcataatatatcatgctctgccctgtggcataaacagccagcgctacctcacctctggcgatcatcccgcagcctatggtcaatgcttcccgggagttataatgaaacagcctggcaattccgccgcagccgataatctttcccacaagaccgagcagtacgaacacagcggcaaaaacaagccctgacggcctgaaatggctgaaatccgcgctgatgcctatgtaagcaaaaaacatgggagtaaaaatcatatatccgctcaccactaccttacgatccacataagaggtatcgtccagcccgctgagcatcagtcccgccatataggcccctgttatggccgctatatcaaaaaattcttccgcgcagaaagcatacatgaaacacataaccaatgcgaaaatacctgtacggcggcgatggggatatttttttaccagcaccttgaacagccagcgaagcagcagcccggcccctatggtaaagacaaaaaagcctgcggccttaagcagtgtgattcccacgctgccgccgccattcataccggtaatcacgctgagggttatgattcccagcacatcatcaatgatcgccgcgctcaaaatagtggttcccacacgtgtgttcagctttcccagctcccggagtgtttccaccgtaatccctacgcttgtagccgccaggatacttcccacaaacagggcattcataagcatgccatggctcgccgcttttcccggccagcccataaacagcaaagcccctgccgttcccagcgccaccggcaccagcactcccatcaccgcgatagccgatgaagcggcgccgctccgcttgagctcccgaaagtccgtttccagcccgctggaaaaaaggataaatacaacgccgatctgcgaaaaactctgcagcacatccatttccgcatcggtaggatgtataatccccataaacccgccggggtggaattgtcctatgatcgccggcccgattaaaagcccggcaattatcatgcctaccacctgcggcagccccagcctgcgcgacagaagtccgagcagcttcgtggcaagcagaattaccgcacagtcaaacagaatgtccattacattgaagtccatacattctctcctcaggatggggcgcatactgtgagatctctgttttcatgcgccccattccggtaggaaaaaacaaagactattccgccgcaggctgtgatcctgtccgggaatcctcaattgataattccattaccaacatagtatacgtcgcatcctgtccctgtgcaagaatttttattattcaaaaccgtattgttttctattcaaaagaggcaatgtatggatgatgcccgaaaggactgatccgctcacttttcctgtctgtaaagcttccagcccatcagtacgatccacacataggcgagtgtttttggaatcatgagcatgcctacggccggagccaccccgctgaacagaacaaccggaaggtaaaagccaaaggaaagagcgactgccagcggcatgaaacggaaaacaggatcctttccttttccggcctctttggcgaaaataacgatgataataactcccattatggcgaagggaatattgcgcaggattccgaacgccagcggctgacggtattccagccattgattctggggcaggaagcaaagggcaatccgcagaatggaaagcacccacatagtcagggtaagcccctttttctcctttatctgataacgttcgcgccagatatagtacagaatcaaatagaagattgtcattgtgatggatgtgataaatttacccacgccaagcgccgccgcattggcctccagccctgttgtccacagggaataggaacggggaaccagatggaaagcgtcccctgcgccgagcagtgcggccataaggcccgcccttttcaccagaggatcctttcccttaaccagcatggtaagccctgcaatgagagcaaagctgaggtataaaacgtcaaaaactgtttctgcaattgcctgtgccataattcattctccttctttaataaatggttcgttttacaatttccaggaaaaaacaaaattcctgtgtacccgcttttaacagcatcgtcatattcatcataacaaagcgggcatattgttccttcgtaaaagcctcatcccagatgtcactgcgcaccttcccgtcctcttccagcatccggacaatacttttctccagaacagccttcatggattccatttttacgaggccggtatcctccacatttcccagactgtgcatcagccttcctgccgagctgtcgatagttttccgcagaaagcaatagatttgctccagctgtccgcagaaggattccgccgtaacctcatccttcatttccgacagcgtttttttccagtattcctccgtaagcgccagcaggatttcatccttgcctgcaaaataattatatacagttccggccgccacccccgctttaccggcgatggagcggatattgaccgcttccagcccttctgagtccgccagctcacgcgcgtattccagcagtgtatcccgcagcgtatcatcctttctgcgcataggggttctcctttcttttttatctctgccgcagtaaatgaacgtgttcatttatattatacgtttcccatctgcttgtgtcaacctttttctgaacatgttcatttataattcaaaaacagcgctcgcaatcctcagatcgcaggcgctgttttctgaatcattatttgtattttcctgtcagcccaaaagcttctccagggcacggtatgcggtacagaacgcttcttccccgtccgtacgtcctctttccttcacttccttttcaagagacttcagtccggcgaaatcggccagatgaggctccaggctcagaaagcccgcatagccctcttcattcaggcggttcagtatttccgccacgtttccgtcccctgttccggcaggaaccacgtccccgctttcccgcatggcatcctttacatggatataggaaatgtaaggccgcagcatttcataggcctccatagtatcctgtccgcactggacaaaattcgcgaaatcaaaggtacagcggaaatgatctccataaaacagcttcatcagatccaggcatctgtccgcactgtccccgtaaatgcctttttcattttcatgaaggagcaccacattcctgccggccgcatattccaccatcaaatccatcctgcgcatcacttcatcccggaacttatccggttcttccccttccggcatgaaaaaactgaacatccggataaatgaggtatccagaatccctgccagctccacgatatgccgataggtttcgaaatgaggttcaaaatcctgggtaatatctatttttcctataggcgaacccaccgcagatatgcggataccgtttgcagacagccggctcatcagcatttcggcttctttttccgtgtaatccgccacaccctttccgtctccgcttcgaaactcaatccagccaatacccagttcctgaagcagggcgatctgcttatccaccgacacatctatctcatccgcaaagcagctgacaggacatttcgttaaaattttcctatccatatcctattccttcctgaaatcctttttattcccgcgcctcctgacctattccgccagttcaacagtctttcccttatatgccgattcataagctcccagcataagaagtatggtttccttcattccttccaaatcctgagggaaacgttcttcttccctgacacaccggtaaaagtctgcgatacagtccttgtgcccgcagccccaatagctcttgcccagggcttccttcttatcaatggcaggcttttccacacggccgtccctgtaataataggtcacatccagatcttcgatacgtatcgtcctgtcttcacaggctatctctatcaggggaggaacatcgtcgcaataggccgttgtggcataaaagcaggctgtgctgtctgcaaaacggatataggcctccatggtatcctccacttcaataatgcccttcagatgatggttctgtatcccggcctccacgctcagaggtgtccccaggaagtaggccagcagatccatggtatgcacggactggttgattagcgcgccgccgccctcggtagccagagttcccctccagccgctttcggtgtaatattctttgccgcggctccaggtgacaatccctctcgctccccgtatttttccggcttcaccggaggcaagcagttccttaaccttaatgacgcttggattataacggttctggaagcaaaagcccagtcttctgtctgtccctgccgccgccttttccagttctgccagctgctcccgggaaataaccggaggcttttccataaacacatgtaccccatgggtcagtccatagatcgccatgggtacatggagataatgaggcgtacaaatatgcaggacatccggtttttcctgttccagcatttcctccagactgccgtatgccattccgccatagcgggaggcaaaatcctccgccctttcctttttgatatccgcaaaagctgtcaaaacagcgccctgaagctggctgatgctcgcggcatgtacggcggctatgcctccgcatcctacaattgctgctttcataattgcatattctgcctttctgccttattttttcattcctttactttggagccgtagcttcctgccgtgctgaaggtcacttcctgtacattttcttttatccgggaattcgcccgcagctcattcagtttttccaggaacagatcttcatcaaagggtatttccaccattttgccgagccagctggacagatgcatggcatttgacagggtcaggccgttgattccttcttcccctctcgccacaagcggatctccccttaaaatattggcagcaaaggcccgcagcactcctgcatgctggggattttccccgtcggtcacaagctccgtgaaatggcctgtgggctttgcaaagccttccgtcgccgtataacagtactctctttcattcacatccagttcatagaaggtaagcttttcatcctcacatacaagctttcctctttccagcgtcacctcaaaacggttggtgccgggcgcatcccctgtggttgtgacaaatacaccggtggctccgtccgggaattccagatatgccgtcacatcgtcttcaatctccacatcatgccatttcccaatatggcagaaggcctgcaccttagagggcatcccgcagatccactgaaggagatccaggttatgagggcactggttcagcagcacgccgccgccctctcccgcccaggtcgcacgccatccgccggaattataataagcctgggtccggtaccagtcggttacgatccagttgactcttttgattttgccatattcgccgctgtggacaatatcgtacattttacggtacacatggttggtacgctggttgaacatcatggcaaacaccttatccgaccgggatgccgcctcgttcatttcccttacctgctttgtgtaaacgcccgcgggcttttcacaaagggcgtgaaggccatggtcgaaggcctccatcacaagcctgggatgatcatagtggggtgtggctaccagtaccgcatcacagcagccggaagcgatcagatcatctccgttttcaaaaatatgtacactctcaggcaggttttctttcgcccattctcttctgctctcccgcagatccgcaacggcggcgagttcaagctccggcacctttccttccaggatcgtggcgcagtggccgcttcccatattgcctattccaatgattcccaatcttaccttttccataaatatctacgctctccttttttattcatgtctctcctgcagcctgcattccgggaaaaatatatttaccggtatcctgctgccgccaggttgtcatagcttgttttcaggcagtcaaaggggcttccctgacaggtatcctgctcaaccagaatatatttgcagctggtattttccaaagtcttaaggatggcggggaaattcaggtttccttccatgacaggagccatctgctgggcaaagccgtctaccgtcatatccttgagatggacacagggtattctgtccttcagaagttcaatccactggcacacatcgcctcctgcggccgcaacccaataggtatccagtgtaaagcccatttcttcggcgctaaagccttctatgaggaattcgatcatgcgttttgccttatccgcaccattgtccggtgaagcaggcagcttctggaattcaaaattgtggttatggtacatgagaagctttccggcagcggcaatcttcttcgccggttccctgaaatcatccataaaatgggtaatccattcctttgtacggtatttatccggcatggcgcctaacccgatatactggcagcccatgatattatgctcttcgataagacggtccgtatcgtaaagaatacggttggggtcgctgtgggtaaggacgatttccagcccttctttctcacatatttccctgactctttccggctttatatccctgccgatagcggatatctggactgttttatagcccatatctgcaatttttttgatggtgaaagcaaaatccttctcattctgggtgtaagctcttaccgtgtacagctgtgctcctgtcctcatacttttttatcctctcttttctgtttttcatgctttttcaggcttttggcagcctttaaggcagtccgccccatttcctttactatagccggaaaacggctgaaaagccattgcacagaagtacttttttattgcaaatatagcgggggtgagatatgctgtttctatcatatgtttttttcatttttaagaaaagaaggagaaccgcacagaatggacaaacaggcacatgtcactacggagcaggtaagctacggctattccgaaagcgaaatccccacggaagaatatgcccttcactgtcataacttttatgaggtttattttttcctggacggagatgtggattatctggtggaaggtacacagtacaaacccactcccaacagccttctcctgctgtcccccaatgtatttcatggagtgaaaataaacgggagcaggccatacaaacgcttctccgttcatttccatccggatattctgtccgtggaacggcgtgttttcttattgtccgctttcccgtcatttgaaaatcagcccgatgagaaaatttattatgaacaggtggagcgcttcggcattccggactgttttgaagcgctggaggattgtgcgcggaaagaggcttctctcagggaacatctccttccagtctgcgtggaagcgctgctcgcacgtattgtatccatgtcagataccaccggaaccggatttcattccacttccacggataccattacagggattctgctgtacctgaaccgccatatgaaggaaaatattaccctggatcagctttcggagagattctttctcagcaagcaccatatgaataaggttttccggaaggctaccggaactacggtatttgattatctccttcataaaagggtaacactggcccagcagctgctgatagagggaagcagcgcccaggaggcggcggcagaagcaggcttcggcgattactcttctttttaccgggcctataccaaaatactggggcactcgccgcttcaggaccggggcgttttgccttcgctggggaacaataacgggaaacagttcgaggatgtgaacttgcggatttagcagtgtcactcttatcaggctttcttttgctactgccaggcgcgccagtaaaccgaaagccacctcttaacgaggcggctttcggttatttacagtttattcatttctcaattttttctttttctttagggcaaaggctgtcaggcaaataactgcccccaaagaagtaaggctccagccaacgagaggcgcgttgtctcctgttccaggacctttgctttctcccagtactcctatctggggagccgccgcttcgcctaatactgctacttctggcgctgcgcttactcccagcactgctgtagtaaccgtaggggtatccgtagtcgttgtcgggttatcgggcgtgggatcatttggtgtgggcggtgtagggggctcttccgtttcgttactgattagctttaagcctatcgcccatccgaaattcatattcatataaatatttgtcgtatataatccatctattatcatgctgagtccaagcaattctgcctcagtaccactggtaaaatcagccaacgaagctctgacagactcttcgtatccggtctccccgcgcatccaattaccaatcgaataatttctgctctccgtttgagaaatcccatccggaagtaaacttaaacaataattataaaagaaattatacccacattctgcaacctctggatttgtctcccgcatatagaagcggttaccaccaaaaatccctggtttactagatcccgaaaccaaaaactccaggggaaattcatcaatagatgtgacatttgtaccataaaacttattatagtaatctacatagtaatggtttaattcttctatccctgcataccccgcccttttcaaaacaccatctaaataatcatctgttaaatatttatgattggcatcactatttggaaaacttgtaacaggagcatctccattattaaacttgtccaagtcctctttttctgcatattcactcagaagaaaaagtaaagctttattagctgtacgattcgggctccatgctgaattacttaacgcaagcaatggagaaccgtcaaatcctattgccccatctacccatcctgatataatatccgcttttgaagtatcgtaattccaagtataactatatttagcatctgtttcttcgtattgagatgcaagactttcagatgctatataaaaagaattgtttacatatgaataatctatccctgaattatttatcaatttgatagtaaaattctccttgcatcctggcatatactttcccgctaaaagagtatttaaatcatcaattgcattaatattaatttctttcttattaaacccttccggtatcgtatattttatatagccgtcagctgagacatgtgatatgtcaaccaaaatcccttctgtcgtaggttcagtaatatctatcggatccgctttccacttgctgttaccggatgtatagctgtagcttcctgaattagcccagggaagaggggtatactgtttttccgctacgcctgccatcagcataataggaaatgggctgaagctgtcggtttcaaaggttacaaccttcttcataccgggaatctgtgtattacgtgcactataatatgccaccgccgccatttcatagagatccgctgccttttccaccttttcctgctttccatcctctgcagtcacatgaagcaattccgctttctgtacttcgctgtcaaagctcagttccttcgtaaatgtaatcgtaacctttaccggtttggaaggctgtacctcttccatcgaaccatcttctgcctttttctcaaaatgaaggccgaaatcaatgtggctcagatattccattccctcattctgcgcatagtcctccaacagccgggaatccgctttttccttgtctgcgaccagttccgcatccttcaggttttcatcatctgccgccgcttttatggtaactgtggctctgccatttccgataacaacatccttcttttcgaagatccgttcttcttccgcttctttttccgattttattacaatctctgtatcttccgttaccttttcacatacataggaaaaactatctgtttctgaagcatctgtcacttctgccgtcagagtttccccgccgcaggtgacttccaaaagagtatagcctttatttaccgtaacacggaaggaaaattcttcttcctcttccaccctgtcagggccttccacggtaacagcatctttatcataaacataagtcagttcaaatccggtttcttcctcaacatcatttccggatacgctgtttccggacacactgccgtttgctgtttccgattcagtttccgattctgtctcagtttcttcttccgtctccgccggtgcttcagttccttccgaagattccgtttcctctgttgactcagattccgcctctgttgtctcttcccctgaagtactctcctcaggcttttcctctgtactttcctggctgccgctttcttcctccgaagcctctccgctgctttcctgacttgtttcttccactttttcttcaacggtttccacattattaccgctgacatcctctgctaaaacggtcagggcatttccggctatcattgccgccgccagaaatatcgctaacatttttttactccgtccgctcattttagactgtctcataaactgctccttcctcatatcccatcttaatagctttatcagttgatataagtctcactgaaacaatagtacacttttccatgttacaaaaagcgttaccaaacaataaaaaatgagccctttttttaattatcatacccgtttccgcatctactactattatatagttttttctcccgattcatttatatttcacatatccacaagccacacctttccctgttcagcatatcttaatgtaaggagatttcatttcccgtaaattatctctaacgaaaggagggatacctatgaaaaatgctaccaagttctgcatcatcaccattgtcatcggtatgctgctggcttttaccatttttacactttttgcaaatggcatgctgacgctggatacttcatctccattcctcaacatacttatactgttcgccggcgccatgctcgtcgctctgctgacaggttcgctggctgccaaaaatgagccccggctgcgggaggcctataactgctgcggcaatctcgctgccatcggcggcgcatgtctgacccttgccgcatttctcacatccttaagcccggatttcagcggaattccgtttgctctgggcattgccgtctgttttttctttcttgtactgcttttgggcggaatcctgtgttttcttcatgcttatttttctttccgtcccgtttcctgcggcagcacttccgccccgggacagacctatacacgtccggggtatgaagaaatccccctgaatgatgaggttggacgctgccgcaggcccatactctgataacattctcttttaaaccatgccgctttttctcttctgtcctcacaaaaggaggccgcctcagatcactccgaggcggcctccttttgtcattccataaaaaatcagtaaaacggcagcttatgctcctgataaaattctttcagttccttttttacatcttccggcagttccgttttctttattttccgtatagccccttcaaggcccatcaaccggttgatgcaggcggagctgtctatgctctggatcttcagccaggcctgtctgcttcccagccgggcaagctgttcctctgtataaatgcccacctgatttaattgctcttccactatttttccgatattcggaagcttgctgagttcacccatattctgttcctcctgttcttcgctgcatccggcggcttttctatataataaatttcttctatacagtatactctacctttgcccggaagaaaagccatccgcctacgataatttccgcaggaatttcttcattaaaatataaatccacaggaaagccgtaagaatggccggaagcataaaaataattttatggtcataaattgtttttcctatccagaaggaaggtaaaaatgacaaaatatacgatatccggccccgcacaaaataaggggcaaatgctccgagaatagtcaatgtggacatttttgtcaccgccatcccctccagtttattggttgacagcgtcactataagcagagcgataataattccctgcagcgctcctgtcccggaaaggaacagaacctccaccgcagacagagctgttaatttaaaaacaggcagtaatataactgtcatgataaaagctattacaaccggaagaaaaatacgcgagatcagataccccttcctccccagggttgtgataaacaaataattttcaatatgatcatcatgctcttccaaaactaccatcgcggtaacaaagcaaaacatgatgggcgcaagcatggaaaaaatcagatcgatcagcccataatacggagcgaaaacttccgttctgcccgtccagcttaccaaagcccgttccattacaggtactgcaaacctgaaaaacactcctgcgagcagcggagcggcacaagatgcaaacagcatcatatcgcgccgtataaacagcatcatctgcataaagcttatccgggctgctttcataattttatacctcccgcacttttccacatccttctgacacatttatgtgcagccacaatcaatactgcaatcagcaaaacaacaacaaataaccccgtcgccgtaatctttttgccggctatcatatccatacagacattgagcggatagtaccgcagtacggcaggcgttactccgaacatatgtaatatggcaggcacgaacccgaccacttctatcggcaccgtccacaggataaattggtttaagcttgaaattttggtcgcaataataattccgagcagtgtaaataccgcgcctgacaatgccgttcccagcagcgtacggggcaaatcctccgcttttacggcgaccgccagtatggctgcaacggcaatcgagatggtacacagagaaataacctttgcgccgatataatcaattgccctgacgggagacaccgcatatgcacagggcaccttctggcttttctccaataacacaatcgcacccataaaaaacagtcccatagcggcaggatcggaaaaaatcagaattgctgccgcggctgtacgccatgattcgggcattgcaagcagaatgatcagataaattaccgttaatacgctgtacagtaaataaaacccatattttatctggaatttcatatcccagacggtcagccttcccagcatcatatcagcgtcctccctgtaatatccatgaaaatatcgttgagcgtaggttcactgctgtgaatggactgcagtctgttttcatcgatcagctttttcagcttttcatcacaggagattcggtcaaggggacagaccgcggtatgttctccgttttctacccaggtataggtcacctttgccgcacccttagacataattaaattatgggggctgtcaagcgcacagattttaccgttgacaataaatgcaactctgtcgcaaagctccgtggcatcctgcatattgtgggtggttaacaggatggttttcccttttgccttttcagccaggatcatgtctttcatcatgcggctgtttgtgggatccagaccgctggtgggctcatccaggcagagcagcgcaggatcatgcagaagcgccttaataaaattcagccttgccttcatccccttggaatagtccgacacccgcttatccgcatcattcgaaagctccaccattttcaggagttcatccatcgggcggggctttttatcatataaagacgaaaaaaacctcaggttttccctcgcggtcagtttttcatacatcgtcgaaaattcaaaatccacaccgatatcctggtaaaaatcagaagtacaccgtttacattccgtcccattcaccaccacagaaccatggtatgtcggcagcatacctatgagtattttctgcagagtgcttttccctgcgccggacggtcctaaaaagccgaatatttctcctttggataccgaaaagttcatatcggttatgaacggattttttccatagctgaacgacaggttattcacagtaatcattgactgctcctccataaattatatgaccaattttatttaaatagtcaaaataagagttttatataatccggcgggctgcgccggattatataaaaataattccttatattctgcttcaaaacagacggcatcttttcagttccctgtactgagcagcatcttgacagctacttcaggttgctttttgaccatttttaatcatgtggtcattataatattatttatctgtatagtcaactgcttttatataaattttgaatcactccgcccggaaagccctctttttcccatcaatataacggttctccgtaatgcagaaggaatccttcagccggttttgttctccttttgccctgtctattcgtaagaaaccagcaaaaaataacacggtacggcatttttcaacaccataccgcgtttattaaatccgctgaacaccgtttttcttccatcctgccgaaatcttttcctgcagtttcggaaagggctttatcccgctcaatgcatcatatacctccacacaggacgcaccggtggcctccgccagctgcaaacagtttttcaatggatacccgtccagcatcgccgtgagaaaagcagctatgctcgtatctcccgccccggcggccgacagcacacgctccgggacatagcttgcttcaaatccttcctgtccggcccagcctgccgtatcaagctccgtcctcttcccaacctccgacaaaacaggttccgatgccgtccggtaatacatacccgccgccccgcattttatgagaaggattttagcgccatatgccatgcattgttccgccaggggacggatatcttcctccacattgagaatttccgtgatatctccgcccttcgcccgctcctgccacagcgcaaaccgttcctgatccagcatataacagagctcttccgcactcggcacgaaaaaatccacgtaaggcagagtatttctcaggatttccttccagtccgccttccctgcctctgattcggaatcgacagccgccatatccagggaagtggcgcagcccatttcctttgccttcttcatgatacggaccgtctccatacctccatttacatacatggaacgcataagaggaggatagccgaaatgaaaaagtgcagtatcctgccaggcctcttccggaatatcttccgcgcaaaaggtatcattggccccgggattatgcaggaaaatacggtcaatgcccggaattgccagaactactgaataggatgtggacgcctgatctgtacgaatcatacctgcgtccgcatcatatttggataacagactgacgactatctctccaaacgtatctttccctattttccccataagggaaacatctgcacccagaagcttcatggccagacctgtattggccacagctccccctgtatgtattctggcatctcccatttggatcagcttgcccggaagaaggatatccgttacagccgatacggttttctccggaaaaacaggtgtgatatccaggcagatatgacctgcggcgatgacttttttcttcataccagcatcttcctttctgtctcaaaacagacagcaggcaaagcggagctttacccgacagctgaatctattttccctgattatccggcagcgccgcctttctttcaaaaagctgcagtacaagacctctgattagcagacgtaaagctccgggatctgccgcccggccgccttcatggctgtaaaccattgccgtaaaaatgttacggaaggctccgccgaattgatccgccagttccggcgcacactcactgcctgccggaaacagctttccgacaacagtttccaccattccggcatcctccgtaaaatgaaccagcagttcctcctttggcagctttctggccaggatttccagttccccggaggtcatcagccgtataacaggcgcttcatccgctttcataaagaaatccataagcatatccgtcactgcttccacgtccggctttcttcctgccaggctttccgctttttccagcagctgcttttctatcgttttatggaattccatcagcacctggaaaaggagctgttctttggactcataaaacagataaaaggtccctttgggaatcctcacccgcctgaccagttcatctactgtagttttcctgatcccgtaggcggccatgcagttcatagcctcctcccgaaggcgtttgtcaatatattctctttcctgttccgaataagttttgggcaagggcatcacctctttttgactatatatttaattttagtcattatagttcttccgccatcttctgtcaagccatgacagcgtactcagtttcagatatcagcagttgccggtaaaaacataagccagcctttcccgggcgatatccgccagttcatataccgtacgtaccctggtcggcggcctgtccgtcattttccaccttgggaaaaaccgggtcacatgaagaggaatatttctgtctatcccggctgtccaggcagaaagctccctcatctgctccggagtgtcattttccccgggaatgattagtgtggtcagctccacatggcaggaagcggctgcccggcggataaaacgtttcaccgtctccaaatccccgcccagcttccggtaaaaatcctctgtaaagcctttcagatcgatattcatggcatccacaaagggaagcacttcctccaatatctcctccgtcacgctcccattggtcaccaccacatttttcattcctgccgagcggacaatccgggccgtatcgcgcacatattcatagccaatcatcggctcgttataggtgaacgccactccgatatttcctttttccttcagctctgcggctttccccgcaagctcttccggagacagacggatggtttccgcatccgcggtacacatggaaatttcatagttctggcagaaaggacagcttaaattacagccatagcttccaaccgataatatccggcttcccggttcaaacatggctaacggctttttctcaatcggatccagggcgagggaagttatccttccataagaaagggagctgctcactcctcccctgttggccctggcacggcagcttccggtctgtcccggcctgagcctgcagtgatgcatgcagaccgggcagatgatttcctgttcttccgcactgcagcctctgctttctttcacactatcccttctctccatggcgtatgacctcgaaacgctccaacgtcaccgtgtcctcttccccgattcccgcctttctcctggcaatggcgatctgctcctccacagtatccaccccttccaaatccggcagcaggagtccccgctttctcccttttgtcactatcactccgtattttttcacatccagttctccgggtgaagaaaccggttccggcgggccaagcacatccacgctgtacaccagggtatccagttcttccttctcaacagggggaaaacgaggatcctccgtaccggaactcaccgcattcctcaggatttcctccgccacacagccggcaaccggggcaatggttccgatacagccccggagcatgccgtccttgtggatggatacaaatacacctgccctgctctctgtcatttccctgggcagtgtttctttttcttccggggtaagtgaagccttccttcctgtccgtacaaaggtttccagggattttcttgccagacggacatagcagtcctccttttccttccgggcctgcatatcctgctgttgcttcagggtatattgctccagaaaacggcgcgtttcatccctgcccgtcacatggaacgtacatatgccgtagcctacgccgaacggcccctgataagacagtttttcggtactgacggcttttccgtccaggcagcctgccatcatggtaaaggaacggtgcccgcattcccccgctttctcacaaaggctttccggataatccagcagctcgccgaaagcagctttccccatggtttccataatcctctgatcataagcaggcccctcttccctgtacccgtaagggccatcctccttcagcctgtgggacaaatccccgctggctaccaccaccgtgcgacgccccagctggtttgctgtcttttcgataagcattcccgcccgataatgatcggctttggacaaaccggacagccctatgcggacaaggcggtactccttcagatatttatttataaaatacaaaggcaccatcacgccatgatccagcttcttttcacgctctcccattatgcccatgggaaaatccgaagcgtcggcattccggcacagacaacggacaaattcctcgtcgtattccgccttaaacctcacttgtcccgcccggaactgccggaaatccccttccgcttcttttcccggcgaaacatggaaataatccgcgtacatcactgtatgcggggatatcacaacaatcgtttccggcttcagcacggcgatttcccctgccgctttctcataagcctctgtcgtttccctgataccgcgttcctcccctttcccgatttccggaacaatcaatggaggatgaggaaccataaaacctgcagtcactgtcatttccgctcctgtctgcacgcctgcgcctgctgccaaaatcacacgtcttctgctctttccgttacagccttcctgtgatattcatgcaatgccataccagtctgccaacccatttgtaactctctataaatcataataggcgccgaattccgccggatggggaatctggctgatcgtcctgctttcttttctttttctttccagccaaatctgaatcagtctttccgggaacactccgttcttcgttaaataatcatgatccctttccagggcatccagggcttcctccagtgttttgggaagagactgaatcttcgcctgctgctcagaagaaagctcatacaggttataatcatatggcccccagccatttgcgcttgggtcaatccggttttcaatgccgtccagccctgccatcaatatggcggcgtaggcataatagggattggctgtggcatccgggctccgcagttcgaacctcttgtcctcgggtgcttttgcgtacgccggtatgcggatgaccgcactccggttggacgtggcataaccgatggtcaccggagcttcgaatcccggaaccagacgtttgtaggaattcgtggaaggattggtccacgcacaaagggaaggagcatgcttcagcaggccgccgataaaatagtgggcggtctgactcaaggaagaatagccgtccttatcataaaataccggcctgccttccttgaacagcagcatatgcacatgcatgccgctgcccgcttcctgataaaccggctttggcatgaacgtggcggtacgcccttccttcacagcggcattttttacaatatatttggtgatcatggtcttatccgccatgtcaaccatttctccaagctccacctcgatttccagctgtccggggccacccacctcatgatgatggtatttcacccggatcccccaatcctccataagcatacacattttgctgcgcagattataggaaatatcctggggagccgcaatatgatatccgcccttatgcttcacctgatatccgaggccgccttcctccgtaccggtattccattccgcctgtctcgtatccacttcataaaaagaaccgttaggcgacacctgataatttacggaatcaaaaagataaaattcaaattccggccctatcagcatctgatccgccgtccccgtggctttcatgtaatccaccgcccgcagcgccacatttctgggatactggtcaaacggcctgttttccttttccccgatcacacagacatcccctgtcatggaaagcgtagggatttccacaaagggatccatcaccgcactgtccggatcaggaataaaaaccatatcacttttttcaataggcgcatatccgtaattggagccgtcaaaaccgattccatattcaaaaatacgttctccgaaccgttccaccggtatggtgatatgcctgaaacgcccatccagatccaccattttgaaatcgatcatgcggatgtcgttttccctgcaaagctgcaggattttttcacttttgcccataaagattacccccgttttttgcggcttgtaccgctttattcctatactgaattataaccctgtccggctgtgttttacaaggatttcagcagtaaaaaaatgagtcagcagctatcttaatttctttacttaattactttatccagccccaaaggatacccaaataatttggagtatgatacaataaaaaataatttatttctaaattgaaacggattgatatgaagtgaaaagtccataaccggggaggggtagcttatgttagataaaaaagaatttccgattttagaatatgacagcagtcctaaagccaaaatagaacctttaaacacagtgtccaaaatagacggcccggaatgctgcgtaatcactttttttggtgatgtcattgaaaatatgcttaaagccaaccgattaaagcagatcgctgttttttcttcctgtaccgtcaagttaccggtttatgaaacggaatatcttggtaaaaagattgcccttacacagggctttttaggtgccgcaggttccgccgcccagctggaagaactgattgccatgggattctcaaagtttattgtctgcggtgctgcgggagttcttcagaaaggaatacaggtagggcatttagttattccggggtcggctgtccgggacgaaggggtgtcgtatcattatatcgagccttcacgggaaatcgaatgcaatccctacgttgtaagcattatggaaaattacatgaagaggaataaaattccctatataaatgcaaaaacctggacgacagaagccttttacagagaaacagacgctaaaattgacctgcgggtttccgaaggctgtgttacggtagaaatggaagccgcagcattttttgcagtatcaaaattccggaacgtattattagggcaaatcctgttttgcggtgatgatttaagcggtatcgaatgggattcacgctcctggtgcagcagagaagggatccggaaaaatcttgttgatatagccttggaaatatgcctggaattacatgcagcagcaatacaaaaacggtgaagcaaagtattcaccgttttatgtattgaaataataggacggggacaaatcactcagtcttctttatctgcgtccagtttcagccataaagcaggacggatgccgccggtacatctgccgtcgcttaagttgccctttaaaatattatttccctgtatccctatattaccgtcaccatggatatatacggcttttacattgacacggccgggtgagcagagccaccaccaccagatgtctcccttttccccttcaagtctcgctgtccgctttccgttattttcatctttcctttcaaaccagtatctttggtttttccccggattgtacagtttcgatctgctgtcgccgaaatatttacatactgcttcctccatgctcagcaaaaatatgcgatcctgtgtgtccgctccgccttttgaaccataccactggttatcgtaatttttattccataccggaatgatttctgctttttctgcctcggtgaacttatcataaaattctccgttgagatatcttcgcagcgcgcagtcggcccatgttatttcttctccttaaccggaaataataaatcaagctgcaaatccttcatctgacctgtctgagcataattataaaaattcagcgtttcttcaaaaccttgtcctgctctcgtttctggtgatatccagcggggagagccccagtcattatcatatttatcgcttgcgttaacccattcctttaacaaacgccaatccccgaagtcccaggagcgcagaacatgcgcggcatagagtcctccgttaaaagtccttcttatcataggcggagcaatctccaggtcatcaggaacggacacccacatttcatatgtcctcgaaggttccccaacacccgtcatttccatagagcaatcaaatccgaagctgcgggcgtcaggcttgatttttagcagtccggtttcttttacgaactgattcatcttatcaagcgcttttccctcgcagtcctcacccgacgcataataagccgccactgtcatgggtggaagataaacaatccgcacatccttgtcttcgaatttattcagcttttcacttgcacggttcagctcctccattgatttttcttccttgaagttaatcttggaaacggtcaatgaatctactatttccagtaaaccggcatcatccggcaatgcaaaggccgcattttcaagctccagatgttcaataaagaccttaataacatgccggatagtggagagcgcagttatttcatcttcgatttcattaaggctgcgttcgaaggcctctatcgcggtacgtgcatcggcgctttgcagaatcccggaaatctgtttcaatggtattctcagcttacgcagaattataatctgacgcagacgcgctatggtttcggtatcatatacacggtaagcaaaattttctttacttgtcggcataagcagcccgatttgctcataatacctgagcgtccgcgtcgagattgcaaattgctttgatacctgactgattgtttgcaattccatatttatttctcctttcgattacaaaataagcataccggttgacgcgacgtcaatgtcaagtaaaaaaagttttaccaaaaagttttcttatctggtttccagaatccggtcgaacagctttgcacattccctcgtaaggctgtgaggaaccacagggctttccgtccttccgtccctgatgcagtttgccacttcctctatctcataaaggaagccgttctccgtaaccgtatcctggaaacgcatcaccagctcattattcttgtcatacagaaatacctcttccgcaaaatgaggatgagggatgacaattttcccttcatttccataaataaccattctctcatgaagcccggccgcaaagctggtgcgcagagacgccagaataccggggaagcgcaaagtcacctgatcggagatatccacgccggtatcactccagacagcagaaacctgcacatcttccacaggctgttctatcatgaaggttgtgagttcataggcatataccgtaatatcgtaggaagctcctccgccgagcttagggctgtaataccggttgtccttgtcaacgggcgcaaggaagccgatcgccgtatcaatgaaggatggagtccctattttcccttcatccatccactgctttgccattttaatggccggaaggaatctgctccacatggcctccatgacaaaaactttttctttttcagcccttgataatacttcttccgcctgggcgctgtttaaaaacatggctttctcacacaaaaccggtgttttataatccaggcagagcatacacagtgcgtaatgggcatcctgggttaccgcgatataaacgcagtccggcttttcttccgccagcatcttttcatagctgtcgtaagcggccttaatgccgtttttctccgcaaagcccttcgcacgttccatggacttacttgcaactgccgccacttcacaatctcccatacgttttaccgcatcgcagaatttattggcgatatttcccgcacccataatggcaaatctgaaatttttcatagttcttcctccataaaaattatattataagtccttctctgctcccacatacattatggcagcggtcaggaaaaataatcagggttcataaaaggtatgagcagctccgtcacctcttccccggcatcaagaccccaatagccggtatacaatccatctcccagtccgctggcaaacatggcgatccggtgtccgtatccgggcaccgcccactcaataaaatccccgtcctcccgctggacatcgggataagcttcatagctgcttcggaacagctgtgcaaaatagtcatcatactggttttttcccggattctgctgatgccatccgtcggaaaactctccgaattcctttgccgccgcagcgtcgcagaagcatgccattccggcatccacgccgaaacccgcgaaaatccccggctggttatactgagccgccgtcgttcccgccggcatggcgatctcatagcggcagatatccgtttcccggattttcaatctggcggcagcaatccgaagccccgcaacaggggagtctaagatcgccagttccaccggataagagcctgccgggattttccggtttaacggctccgtgtatttatcgtttcccagataaacaagcggatccgctatgataatctccccgctggggaagtctgcctcacccatacaaaagatgcgcagatcaccttttttatgaaaatacctcagcagctcctccgccggataactttccttattcagatacttcaaattctgctcaaaggcttcctggattggtgccttcacgggttcccggatttctttcccatttccggtatccacaaaataaccgccggatgcatccgttctgaattcaagatccgctcctgccggcatatgcaggatattcagcaccgcaggctcaatattggccagcgtattaaaatccacaacggcataattagccgcgtcgtccacataagcctgggtatcggactctcccagggcaacccatccgttaccaatcccgtctttttcacggaaaagccatttcagtcccgtttcaccgtttaaaaccgatttggtcaccacacaggctcctgctcccgttatgtattgtttcagttcttttttcttttctttttttccaaatccgaacattcctcttcctctgtttccgaaggctccgtttccagctccttctgcacctttctgctgaatgaatgcagcacctgttcataggcatggtcgatcatattgagcagttcctcatccgggagcctgtcatggtacaccgtattccaaaaaggctgctgcacgggagggcagtgataccctctcacaacgatgcccggataaacctgacggtaaaaatcccccgcatcacgactgcattttaatgtaatcttccgatcctcttcgagaggataaatctgtgcaaatatcttcccgttcagcttatagcagacaggaatatccccaaaaggatgatcctcataagccctgtttttactctggcaataggcctttatatcctctgttttcaccccatactccccataaccgcatttccggtttcttcttcatttccggttccgataagcttcaggatctcctccgcggtttcttccgccgtcatatccgtcacatcgatccggggataatccacattctcataaacggccctggaattacggatcccccgccggatcctttcctcatcccgtccgtcagccctggccctgcggacattttcttcctccccgcagtacagcaatactggtaccagttcaaaagagatacctttctgccggagttcttccaacagggcatcaaacaactgtttcctgtgtccgtgaaaaccaaacggaaatatgacattctgtatttccccgcaggcaaaggaattctccatcatagcgaggatatttttataattcagccggatcagctcctcattaaatatgggaggattggtcatccggcagtaatcactgtcaatataggaggaatgcggcagccttttcatcagttcagcgctagccgtggatttcccgattccatttgcaccgcatagtaatatcagtcgcttcatttccattcttctttccatatgattgcttccttttattatatattgtataatacattcaatcaagcatgtatgcgcttacactaacttcggaaggaatttcaatatgaacatttacgatatctccaaacaggcaggcgtctccatcgcaaccgtatcccgtgttttaaacggaagcgataaggtgagcccttccaccagggaaaaagtgcttcaggttattgaacagaacagctatactcccaatgcctttgcccgcagcctggggctgaattccatgcacaccgtgggaatcctgtgtgcggattcctccgatgtttatctggcgtcagccatctattacctggaaagggagctgcggcagaattcgtatgcttccatgctctgctgcaccggctatcatctggaggaaaagaaaaaatacctgcagctgctgctttcaaggaatgtagatgccctgttttttgcaggctccaatttcgtggaggatacagaaaaaaacaactcttatctttttgaagccgccggaaaggttcctgttttcatcctgaacggctatctggcgggagatcgtatctactccgtcctctgtgatgaccgcctggcggtaaatgagatgacggaatccctgttccgccgcggttcccatgcccctgtctatctgtaccgcagcctgagctacagcggacgtaaaaaaatagcaggcttccgggaagcctgcataaaaaacggaataactgatgcggataagagaatctttgccagccccgcctccgtccatgaaacagccgactttctggatgctctggaaaaagaagggctttcctttgacacctgcgtcacttcggatgatgagctggccgtaggcgcggtaaaatttgccctatctcacggaagaaggataccggatgagtttcaggtgaccggttataataattccctgatttccacctgcagcacacccgaaataaccacagtcgataaccgggttgaattcatgtgcacaacggcggtctccctcttaatgcaggccctggatggtaagaacattcctgcacgtaccgttttctccggggatattattcagagggaaaccacgattaattaaaatccatctcattctctgccatcatcgcggccgttaccgccggatggtggtattttgtcctgttctgtgtcttgtttttatagttgatcgcctggcgggggcaaaatacaatacacgacatgcattgggtgcagtgatgcagaaaaaccggttttccatccttcctggttatatttcctgccgggcacaccccggtgcatatcccgcaggaaacacagtcctccgaaacggtaaaacctctgtctttcttaggaagtgcttttacaaagggggtttgtatgcagcgcatgatttcttttcccacgcttttcctgaccggttcattcaccgttctccgggcgatatccccggcgatctcttccaattccgccgccgctttcggcagctgtttttccggttccggaaatggttcatacatcgctacatagcttgccacattattatgtactcccgaataagagaccctggctccctttttttccagcatctgtgaaaaatcgttcagcgcattcaccggaaggcctccgcaggaggctaccgcaaagatataggcattcttatttatttcaagcctctcaataaacttacgtgcatactctggcagcgaccaatggtataccggaaaaataaatcctattgtatccgcctttgccgctgatacagcggccggatcatttctcatggaaataattttggcaggctttatcctctctgcaatttccattgccgcatgcagagaatttcctgatcctgaaaagtaataaattctagtttctcccatttttcatgtctccttccgccgcatatccggcatacatccgcttcatcgcttccatgtcctccaggccaaacagctgcgtgccgaagctttccagcagccggaaaataaattccagccttctgcatatttcatcagccgtccgatctgttatgaccggatccagccatacatccagcagcagcagaagcgcctcggcaagctcttccggaaaatcgcaccggaattccccgttttcatttccctgcctgataattcccgcaacccggggcgcgatatatttatttccttttctcaccgtatccaccagggcatacggcaccttttccacccagcggtttcttatgagcatgctctgattcttattatcaaaaaagtaacggataattctgcttatcttctcttttaccgtcagttctgcgttctcttccatctcctggaaaaaagtatttaccttcatctgcgcatcggcgatcatcgtgcttaaaatctcctgtttccctgcgaaatgatgataaatcgccccttttgacagaccgctttcctccataatgtcctgcatggtagtctcttcatagcccttcctgataaaaagggaagcggccgcttccaataccctgcctttggaagccatggatttttcctcttgtttcatatttcctcacccttccgcgctgtgccaggaggcccggtttctgtgggtacggcgcagactcacagatggcctaaaaaagccttttcaaaaataaaccgtcagtcggttttatttagtatagcatcagcccaccggagccgtcaatgactttattattatatttaagagaatttttattgcaaaaaaagacatatcaactccccggacagttataaaaaccatccggggaactgatatgcctcaggcttccgggcaatcctccgctatttttcttccagcgcgaatccgaaataccggacggcattattataggatatcccttttataatacgcttcagcgttttttcatcagcaggatattccccgttctccacccagccgccgatgagctcacacagtatcctgcggaagtattcatgcctgggataagataagaagctcctggaatccgtaagcattccgataaaattccccaaaagccccagattggcaagggaagtcatctgcttcatcataccattcttattgtcgttaaaccaccatgcggagccctgctgtattttcccaacggcatccgcattctggaagcagccgataatactgccaatagcttcatcatcattgggattcaggctgtaaattatggttttgggaagggctccctttatattcagggcattcaggaaatccgccatctggctggagggcgcataattattgatacagtcataacccgtatccggtcccagctgcccgtacatggaagtgttgttatccctcttgcagccataatgaagctgcatagcccagcctctttttgcatattcctccgcaacgaacagcataaaggccgttttgaatttcaattcttcttcccggtccggattttcccctgcgagacgctttgcaaaaatcttctcaatgttttcttccgtttccggaacatacatcacgtactccagcgcatgatcacttgccttacagccatagctttcaaagaaatccattcttttcttcagcgcagccttcagttccgcaaaagaacggatttccatctctgccgccgctcccagcttctctatatatgacgtataatccggcttttccatattcatggccttatccgggcgccatgcgggaagcacctgtacctcaaaactcctgtcctctgccagcgccttatgccagcgcagatcatccgccggatcatccgtcgtacaaataagagtaaccgcagactgccggatcagattcctgacactcatgctgtcttcctgcagccgtgcattacacagcttccatacatcctctgccgtctccccgttcagaatcccatgatatccaaagaaacgctgcagctccagatggctccagtgatacaaaggatttcccacagccagttccagagtttccgcccatttctggaatttttccctgtccggagcatcccctgtgatataatactcgtccacaccgttggaacgcatctgccgccatttgtaatgatccccgcccagccatacctgcgtgatgttttcaaattttctgtcctccgcaatctcccggggattgatatggcagtgataatccaggacaggcatgggttccgcaatttcatggaacagcttctttgccgtatccgtgcttaataaaaagtctttgtccataaatgccttcattttctcttcctccgtttatgtaaatacttacatttttctttcattatatcctgcccaaccataaaatgcaattctctttatattaactttttaaccaatgattttatcatcttctatacataattaataaatcttcctcttatcctcttatttttccaaaaacaggttgactccgggaataaagaggtgtaattttaatgtaagcccttacatttcttcaaaggaggattacataattcatgcagacttttatccgcatccaccccggagattccgttgctgtggcgctgcagccccttgcagccggtactgttatcttggcggaaggaaatcaactcaccctgcaggaggacatcccacagggacataaatttgccctgatacccatccgggccggagagcctgtcattaaatacggcgctcccatcggcacggctgcagccgatattctgccagggtcatgggttcataccgcgaatctgaaaaccggcctgggagacatactggactattcctaccagccctccccttcccttcaggaagcccgtgaaaatcctgcccgtccggaagattctccctgcttctgcggctaccgcagggaaaatggccgggcaggagtaagaaacgaaatctggatcattcccacagtcggctgtgtaaacaacgccgccaccgccatagccagccgggcccaggggcttgccgcaggtaacctggacgctgtcgccgcctttccccatccttacggttgttcccagatgggtgaggatcaggaaaacacccggcagattcttgccgatctcgtcaaccatcccaacgcaggcggcgtcctcgtcctcggccttggctgcgaaaacagtaacataggagaattaaaaaaatatatcggcccctacaaccctgaccgcgtcaaatttcttgtcgcccaggattcggaggacgaaatcgcggacggcctcgccctggtaaagcagctggccgactacgcccgcacagcaaagcgcgaacccattccctgcagcgaactgattatcggcatgaaatgcggcggttccgacggcctgtcgggcatcaccgccaatcccgccgtcggtgttttttccgaccttctcatcgccgaaggcggaacgaccatcctcaccgaggttcccgaaatgttcggtgcggaaacgctcctcatgaaccgctgtgaaaacgaagaaattttccatcagaccgtagaccttataaacgattttaaaaactatttcacagcccacaaccagaccatttacgagaacccgtcccccggcaacaaaaaaggaggcatctccaccctggaagacaaatcccttggctgcacccagaaatccggctccgccccggtccgcggcgtcctttcctatggagagcccgtccgaacccacggcctgaacctgctgagcgctcccggcaacgacctggttgcctccacagccctggcagcctccggcgcacagattgtcctcttcaccaccggccggggaaccccctttgcctcacccgtccccacagtaaaaatatccagcaacctcgcactttcagaaaaaaagaaaaactggatcgattttgactgcggccgcctggtaacaggcacctcgctgtccgaactgggaaaaatgctcttcgactacgtaatacgcgtggcaaacggcgaacaggtaaaatcggaagccgccggttaccacgacatggccattttcaaacaaggcgtcaccctataggaggaataaaaaaatgaacaaattatcataccagaccctgaaagaaaaagaatttaccggataccttctgaaagaagcccccgaacgcgtcatccagttcggagaaggcaactttatgcgtgcctttgtagactttttcattgacaacatgaatgaaaaagcagatttcaactccaaagtggtattagtccagcccatcgcccccatccccggagcctttgacctcaaggatgccatcaacgaacaggaaggactctacaccctctacctccgcggctgcgaaaacggcgaaaaagtaaacaaaaaaagaatcatttcctgcgtgagccgctgcctcaacgcctacaccgacttcgacgccgtcatggcctgcgccgaaaacccccagctgcgctttatttcctgcaataccacagaagccggcatcacctacgatcccgcctgccgcttcgaagaccgccccgcatcaagctatcccggaaaactcacccaatttctataccacagattccagaccttcggcagccagcctggcaaaggcttcctcatcctcgcctgcgaactgatagacgacaacggaaaagaactggaaaaatgcgtcctgaaatacgcgtcccaatggaacctcggccaggactttatccaatggctccaaaaagaaaacaccttctgctccaccctcgttgatcgcatcgtaaccggcttccccagaacagaagcccccgcgctgaacgaagaaaacggctacgaagacaacgtcatggacacaggagaaatcttcggcttctgggttatcgaaggcccccagtccatccgcaccgaactccccttcgaaaaagcaggcctccccatcctcgtaacagacgaccacaaaccctacaaacaacgcaaagtacgcatactcaatggagcacacacctccatggtactgggagcctacctcgccggccaggacatcgtccgtgactgcatggaagaccccaccatccagggcttcatgaacaaagccatctacgacgaaatcatccccaccctgaccctccccaaagaagaactccaggatttcgccgcctccgtaacagaacgcttccgcaacccctacatagatcacgccctcctttccatttccctaaactccacctccaaatggaaagcccgcgtcctcccctccctgaaggcctacgcagaccaaaagcagaccctccccccctgcctcaccgcctccctcgccttctacatagccttctacaacggccacaccctcaccgaaaccggcctcaccgccacccgccccaaaggaaacgactacaccatctccgacgaccgccccatcctggaattctttgccacccaccgccaggacacccccgaagccctagtccacgcagtatgcaccaattcagccctctggggcctggacctgaccaccctccccaacctggaaaaaaccgtctgccaagacctaatcctaatccagcaaaaaggagcctacgaactaatgaaaaaatgcctcaactaatttttcatcccaactaattctccataccaactatttaccacccaactatttttttcctcacctattaacccaatcttattattaatccctttatcctccaaaaaccaggccggattccccttctccggcctgtcatcttttcccttctcccttttcccttctctcttttccctttctcttttctctttccccccgcccaccactaccccaggataaacccatccgccgcagggggcctcccgcttctgccggaccccggttcttcctccctcaccgccgctgctgtgggtatgggttggggggacatctgagaaaatggtgatgtttcttaatgctccgctctgccgggagactgccgcccctagcggcatgtctgacgaatgaagccgactgaaagtcgcttcatgaggagttctgccgcgttggcagcctcccggcagaacggaacatttagaaacaccccattttcgaagctgccccccaacccatacccacagcagcgacggcgagggaggaagaaccggggtccggcggaagcccagaggccccctgcggcggatgggtttatccgtcccaccccatttacatttttttcttatagtgttatgcttttcctatgaaaaggaattctgcccccgcagaatatgggtaaactaaaagatggcaataaacaaagcaatgcgaaccgtcctgaaggctctctcctacggcgacatcaatgtacagtcctccagggcctttgccaacatcaaggcaatcgatccactcaagcgcttttacagaaccatcgataccaaaatatacaacggcgcctatgaggttcccacccgcatctatcttccgggagaagagctccccgccccaaacgggatggaaggaaataccctgcccgtgcttttgtttctccacggcggaggatgggttacggaaagtgtggatacttatgaccgggtttgtgccggattagccaaagacacagggcacgccgtggtttccgtcggttaccgcctggcgcccgaattcccgtttcctgccgggctggaggactgttatgcggtggcaaaggccatttataccaaccgttttcttctgaatacggatccttcccgcatcaccctgataggagacagcgccgggggcaatctcgccgccgccctgtccttaatggcaagggatcgcggtgaatttatgccgcagcggcaggttctcatttatccggccgttaacaacgattattcggaggcttccccctttccttccgttatggaaaacggaagcgattttcttctcacacggcagaagctgtgccagtacctggattactaccaaagcagcgaagaagatcggcagaatccctattttgcccccatactggagccggacttatctaagcagccccggacactgatacttaccgcggagttcgatccgctgcgggatgaaggggaggcctatggacgaaagctccttgaggcgggaaatgaagtggaaatacacagaataaaagatgcactccacggttttttcgccctgggcatcaaatactatcatgtacaggaaagctatacaatcatcaatcaatttctgaaggagaatgaataaagtgtttggcaccaaaggatctcattggagaaaactggacaatgccgccaaaattttcccggccaccagcaacaaaaaggatacccgggttttccgcttctattgtgagcttaaagatcccacagacggcagcatattacagtccgcactggataaaacgatagataagtaccctgttttcctatccgtcatgcgtaaaggctttttctggtattatctggaaaaaagcgacctgaagcccaaagtaaaggaagaggtggatcccccctgtctgaatctgtacatcagagacaggaaaacccttctgtttcaggttgtctattataaaaaccggattaatttcgaagtttttcacgccctcacggatggtaccggagccatacagtttctgaaggagcttgtaaaaaattatctgattctcaggtacagggacgccgccctgcccgatatatccttcacggaggaggatatgactctgcaggaccaggaatcagacggattttccaaatactattccaagaccgaaggccgccagggcaaaaaagccagctccttccagatttccggcccgcgtacaggttatggaagcctgaatattacggaaggtcttgtatcctgtcaggcgctgcttaagaaggccaaggaatacggagtctccatgaccgtttttcttaccgctgttttcctgtgtgcaatccatgaggagcgcagcagacggcagcggagaaagcctgtaatcctcatggttcccgtgaatctgaggaaatatttcccatcatcttccatgctgaactttttcggctggatagaaccgggctatcttttcgcagaggaagatttctcttttactgatgtggtacagtccgtcagcgcttatttccatgaagagctgacaaaggaaagactggggcagagaatgagcagccttatgggcctggaacaaaatcccatcctgcgtattttccctctggagctgaagaatctgggcatgcagctgggcgcacagcttgcaaaaaaggatgtgtccgctgttttttccaacctcggcgtggtttccatgccaaaggaatacgttccttatatcagccggttcggcgtctttaccagcacgcctaagatcgaactgagcatgtgctcctttgaggatgatttggttctcagctttgcctccggttttcagaatcagaatattgaacggaattttttccgtatactgaaaagcttcggtgtggaatcctccatactggaagacaggtttccggtcaaaaaagcgccggaatataaggggctccgctttttccagtggttttccttctgctgtattgccgccgcctgcgccgctgtcatggtaaatattattttcacaccgacactgcgatggtccgcctatgtcatcggcggttccttaagtatgtggctcgcgcttgcactcggattcttcaaaaggcataatctgctgaagaatgccatatggcagatgcttctcatcccggccgtgtgcgtgttgtgggatctgtttaccggctggtatggctggtccgtggattatgtgctgcctgcggtgtgccttctcattcagttatccatgctgatcatcacaaaagtacagaagctgaaggtgcaggattatatgatttattatattctggccgggctgtacggcctgcttccggcggtgcttctgattacaggagccgcccacgtcatgtatctgtgcgttctctgcagcggcatcagttttcttctgttgaccgggctgctgattttcaaggggaaggaaatgttctccgagctttataaaaaactgcatttttaaacgtaaaaaaggaagaacctcatcgttcttcctttttcctactaataattctcacaattcagtgcaaaatatccctgaggatagccgcaggccggacatttttcaggggcgcattttccaaaatgcacatagccgcagttcaggcagacccaaacctcttcttcctccttgcagaacacctctccgtttctgagattttccgcaagctggcggaatcggaaatcatgatgtctttccacctcacccacgttgcggaaaagctttgcaatatcaaaaaagccttctttttcagccgtttccgcataatccctgtacatttccgtccattcatgtttttcacacatctgagattcattcaggatctcatccagcataggcagagcgccttcattcatcatacgaagccaaatctccgcatgctcctgttcattttttgccgtctcttcaaaaatattgcctatctggcggaacccgtccttattggcaatgcgggaataaatcctgtatttggtccctgccagcagttctccgtcataagctttttccagatttttataggtctcactctttttaaaatccatatccgtatcagccgcttttcttttatcatatgaaaagccggcctcagccgttacttatcagcgcaagcagcttcaccatatcaaccggcttcgtcaggtatccgtccataccgctctgcctggcccgatcgatatcctccctgaacgcgttggctgacaatccgattatatgcacaccggctgcatccggacgatccatctcacggattctgcggcaggcctccaggccgtccaaaaccggcatctgaatatccatcagaataaactggtaatagtcaacagaggaagcttcatatttttcaaccgcttcccttccgtccatcgccagatccacctgtgcaccattgctttccagtaagaacgtaacgatctctgaattaatcgggttatcctccgccagaaggatcctgctgccggcaaggctgtcaggagactgcttcgaaggattgtccgaattccgccctgtttccctgctttctttatcctgatccagaagcaccgataccttaaaccgggaaccttccccgggtttgctctcaacagtgatttccccgcccatcattttggaaaaattctggctgattgccagtcctagacctgtgcctgaatactgtctggatgttacggactgctcctgctcaaaaggctcgaataacttagcctgaaattccctgctgatgccgctgcctgtatcggtaatcagaaattccatagccaccttgtctgtcccggaagcttttccgcaggcctccaaagtcaccctgcctccggaaggcgtaaatttcagcgcgttggaaacgatattaaccagaatctggcttaaccgcagttcatctcccgttacatgttccagggactgatcttcatatttcacagacagttcaataccgccgtcttccgccttctgcttaaacatcacataaaccctgtccaaaacctccgttatgcggaaaggctcatgggcaagctccacttttccgctttctattctggacatgtccaggatatcgttaatcaatgtcagaagataaccggaagaaagatctatcttatccaggcagtcagccagcttgtctctgttgtccagggaacgtctggcaatttccgtcatacctataatcccgttcataggggtgcgtatttcatgagacatggaggaaaggaactcacttttagcctggctcgctttttccgccatatccagggcatgctgcatttttctctgccaatgcccgtaaaccaggaataaaaatacaagaagaatgaaacctacatttaaccgtaccagaatctcttttgcagacttaacacgcttttccgaatacctttccgccgcggataccaccttgtcggctgttgtaaaatggtcttcgctcatttcaaacagcctcctgctgtccccgttctgccgtacattcatgatttcttccttcagggcctgccacttcagtgtcagttctttcagcagcgtccggtattccgcatcagggagggcaatcagatcatattccccctctccggtactcagttccgataaaatactgtcaatatattggaccagctcatcgttgggatgctggttcatttcctgctttatgagcctctgtgtggctccccgcacgataccagcataattgattactcttgcatttccctgcatacgggaaatggtggaaaaagaagttatgctgataataccgaatacgactgctaaaaggacaatgatcaaacgaacaataatattctgtatcgttttatttacgttatgtctctccgcccacatgaagcttcctcccggtgcctgcaaattcgatcttacagcactcctgtttttccggccggcgtccctccgccggttctttccagaatccgcaatcttgatcagattatatcatacgcgatacatttctacaaataatctttctcatccggttttctggtaacatatgtataaaaaagaagcaagacagctgtcggaatatacgacagcctgccttgccggcaggtttactgatatgatttattctatctggggcgtatctctgcagtcaagcagcggagaattacaataacctgttatttatttaaggttctatttcattcaagaactcagatacttcttttcgggtacgaaaggtcaagaacattttttcaggatgattttttcgtatattcaggataccgggccggcatttttccgggaaattccatacccatcccaggaactgccaaaaagccttatccttcttttcatccagataatccgggaaatcaacccttttatgcccgtgacgcttccacacgctataaatgcacagcagtctgttaatatcaaaaaacaaaatcaaatcagccgcttccactctcatctccagagtttcatgatggtttccgtctataatccattcccggccgcttatgtattccctgtttttcttctcccattcctcctgcggaggataagtccagccgggctgccagcattctttatccagataaataactggatatcctgttttttctcccagcctttgagccgtccagctcttaccgcttccggaatttccgagaagcatgattcttttatatattttccccttatatctcatggaagccccctccgcattctcttagttccggcattatttcatcctcttatatctcttccccctgcagccggcttctctttttcctgacatagatcaggtacggaacttcaaaaagcagcatggcgctccagccggcggcacaggcaagggccacgccatagatacctataacaggggccgtcagataggtaaccgccactctgatgcttgtctgtataaaggtaccggccagggtgattcccattttcccaaggccccggaaataaccctgcaggccattggtaaaggccgggagaagatagaaaaaagccatggttttcagatatcggctacccagctccaccacattcctgccgccttcaccgcttatgaatgctttcatgagcacattccgcgccaggaaaaccaccaggaagataaagatccaatataagaattccatcattaagcctgtgcgcagtccgtcatctatccgccgcgttttctgttcccgcgtcccttccgcgcccagattctgggctgtaaaggtagtcattccgtgggaaatgctctgttccggcgtaaaggcgaaatcatcgacccggttcaccgcctgaaaggccgcgatcacatccactcccagcgggtttaccgccccctggatcaggagcttgccaaccggctggcaggcctgctgaagagccgtaacaccgccgtaacgcagtgtctttttcaaaagtgcgggatcgatccgaaagttttctttgtccggatgaagcagaggaacacgcttttttatgtatatccatgtaagaactgcggatacgctctccgcagccacagtggtaacggcagaacagacgatgccgaaccccagacctcctataaaaatcaaatccaggagtccattcagtagggaagcaaacatcaggaattttaccggagtgcctgaatcccccacacttttcagggccgctgccagtgcattataaaaataggtaaacggagcgccgagtataataattttaaggtaaatacatgcgctgtcaagaacactgtccggcacgcggagcagacttaacagaggcctggcaaaaaacaggccgcagacagcgacagccagggaaaaataaaggccgaataaaaggattgtcgataattcctttttcagttccccatgccgtccggctccgaagaagccgctcatcagaacgcctgcccccatgcagataccggaaattccaagtatgatgatattcataaccggccccgccgttcccagggcggccagcgcttcttttcctataaagcggccggcgataatggaatccaccgcattataagccagctggaacagattccccacaatcaaggggacggaataccggaccaaatgccctgtaatgctcccttttgtcatatccaaagctgccatgttccccctccgtttccgcagcgcaccctaatcgtaaaaaccggcagctgccacagggattttctcccgtccgggcattctgccggtctttcccgataattatatcatttcctggcttatgcttccagaagttctttcacgcaggccgcaattttgtcacacttgcagtttgcaaagaaatactcctgaaaatgttctcctgcaatggcaccctttaccagttccggatccaggtttttgagaatcgtacacagatcattgtgtgtgacctttttaacctcatccaggatctttttgttccgctgctccggaatcactctttccttgggatatccctgtccgctttctccatcaaacagcttctcaaaaatgtattccaggttcagttccgctccccatccgaaaccttttgcaaaaggaagggcaatggcgtttccgtcgttgatctgggcaaacatataggcatcggagggatccacaacatgtccgcagagcacgccggggaatgcattgcatgcaagcatcgcgccttcgcctgtgccgcagcccgtaatcacgtaatcggccgctccggaattcagcagtacggctgccagaataccattctggacataagttaactgatggtcatcctccgcgctgtacattccgtaattgaatacttcatggcctttgggctccaccactttcttaaggactgcttctacctgtgcattctttgctgcctggctgttttcgttaattaatgcaattttcattcctgttatcctccttgaattcgaccctccgtcagatttgcggagcagcctgtattaccgataattatacaacagtttttcctccggcgcctgtctattctttaccttaatcatgcatattctgccctctgtgaagccctgctgaaacagaaaaaccggatttgccggcagttcaggctttcttttcctgctcactgtgctataatagaaaattggcggttgtcattaaactgccggaattccctatataagcttaccaaatgaaggacaggaagaaacgtcatgaataaaacatctaaaaccacactgatgacagagggttccatctggaaaaaaatcatagcatttgccatccctctttttttaggcaatctttttcagcagctttataatacggccgattctcttatcgtgggaaattttctgggaagcgaagccctggccgccgtcagttcctccggaagcctgatttttcttctggtcggttttttcaatgggatcgccataggcgccggtgtggtcatcggccggttttatggagccagacagattgagaaggtgcagaaggccatacatacaaccatcgcattcggccttgcagccggtgccgccttaacggtgatcggcgttttgcttacgccccagctcctgctgtggatgggtactcctgatgatgtactgcctaattccatcatatatttccgtatctatttctgcggttcccttgcctttgtcctctataatatttttgtgggtatccttcagtccgtgggggacagcagacatcctctgatttatctgatcatttcttccgtcgttaatatattgctggatctgctgtttgtaggcgttttccgcttcggcgtgggaagcgcggccctggctaccattatttcccagtttgccagcgccatcctgtgcctgatactcctgacaaaaagccctgaggattaccgggttcatttccggaaaatccgcttcgatttctttttcctgaagcagatcatccaaaacggcctgccgtccggtttccagaattccattatatccattgccaatgtagttgtgcaggctaatatcaacagttttgggaaaatggccatggccgggtgcggggcttattccaaaatcgagggcttcggctttctgccaatcacctgcttcgccatgtccatgaccaccttcatcagccagaatctgggcgccggcaagtatgaccgtgccaaaaagggagcccgtttcggtattctgtgttccgtcatcaccgctgaactcgtgggccttctgatctacgggcttgctccggtactgatagccgcttttaataatgatccacaggtggttgcgtttggtaccactcaggcccgcaccgtaacactcttctattttttgctggccttctcccactgcgtggccggtatcctgcgcggcgcaggaaaagccatcgtccccatgctggttatgatgtgctgctggtgtatcatccgtattacctatatcagtatagcggttaaaataattcccgttatcaatgtaattttctgggcctatccgctgacctggacactgagttccattgttttcctcatttatttcctgaaagcagactggatacatggatttgagcgctgagagagctgcttatgggcggggatatcatggacagccgtcaactaattcgtccgaaatcctttttcttcccagcatgccgaagctgtcctcacttcttacataatcataaatgagaagcccttctttgttccgctccatttccagtaacacggctccgttgggatcgattaccgcagtcggggccgtttgaaaggacgagatatcatttacggaaagaaccgtaaatacattctccaccgccctggtccgtaagtgtgcttttatcagctcatagcgttctttattctctgtctgtgatatatcgcaaaaggataccaggcagagttccgcgttttcccggtacagttccctgaagaattccgggaaacggacttcaaagcaaatacggattcccatacggattccatccacttcataaattcccatctggctgcccgggacaaaattatctctgtcccatccccagagggctctctttccatagatgtcagcccttccttccggcgaaaacaggagcatgctgttgtaataccggtcttcctctttctcaatacttccggccgctatatacatggaatgctcgatagacagtttacgcagacattctttatatttcatcgccgctgcataatccacctctgatacagacggaacctccagcgggggatacccggtaagcgcgcattcatggaaagccaggaaacggaccttatgtgacgccgcctgggaaacggccttttctatcgttttgtaattttgccccatatccccgcttccaggaaattgatacagtccaatccgcatttctgcccccatcttcattttttgtctctccatcagattttaactgtttatgaaggaaagcatattcctaattaaaaaaatcaaaaaacgtatccagccctatataccggcttgctaatgggaatccgtccttcaccatcgatacaaatctgtcactgaaaccataacttttaagcatatcgaagggaacaaattgtacatccgttatctccacggtgtcatatgtacagtggggaacatgaatggcaccggccagccttttcacacgcagcagaatatgaagggcacatggagcgctgaaattggtatcactgatcgccagcagttccttacattccacatgcagtcccgtttcttccctcatttcccgaacaattccctgttcgatagtttctcccgcttccagctgacctccgggcagataccactttcttccgtccgacattttctgccggatgattaaaagctctccgtcttcctctaatattcccgtaactctgacgagaaacggcgcattctttctccccatattttactcccagcccttccacacctccggccggtaaccaacagttgctttcttcccgtttctcaccaccggtgttttgattacctgctggttttccaaaaccttttccatcctgtcctcttctgcgatataacgcacaagcgccagggcatccttatccctgcagttctcatccagcaaagcatccaggcctcccccggcctggcagactgcattcagttcccccttgctcatgcctttttcctttaaatcaatgtactgatacttaatgccgcgttctttgaaataccgctccgcctttttggtgtcaaagcattttgtttttccgaatatctgtatattcacgctgttctcctatctcataaaaatctcagccatgccattcttcaccggcatgcccttcttcaccggcatgcccactgcttcagcaccgcagtctggttccctgtttctttgtccagcaccagtgtatccgtttcataacgcaccacattgctgcagtaagacagaaactcttcacaggttttaagcaccgggaacccgcttcctgccgtccggtaatgcatgggaatcaccacgcgcggccggatctcttttatgatttcatatacaacagagggttccgccgtatagaagccgcccgcaggggccataaccgcatccgcacccttcagcagatccagctgccagttttccggccggcagccaatatctcccagatggatcactttcattccctctccgtggaaaatatgaatggtattcgggccgcgccggctgccgccctcatcatcatgccagctttccacggtttcgatgcggaagggattcctgaccaggctttcttctgttttcacacaggaatctccatgatgatctccatgcccgtggctgcatacacagaggtttgccgtcacatccaaatccctcagcccgggtatggaaccattttcatacggatccaccacaatggaatacccctctgaactcagcttaaaacaagaatgacctaaatactgtaatttcataaaccctttccccctttgcttatctgctgtggccgccgcctccgtgagatacgccgccgctggaaacatgtcctccgccgcccccggagccggagccgccggaaccgccggtatccctctggatgtggcgccttgtcaccgttttatgaagaaacatatcgctctggttccgtatctgaggatggcctcccgccacgtaggttgttacaccggtcgttttccggcccttattccggcttaaattgacacctatgtatatagctgtggccaccgccgctatgagaatcactgcggctgccggaatttcctttttgcccgtcatatcggaatagaaaagattgacgtattttttataagcctgataaggattgctgtccacatcctccagcgcctcgttcagcagattgtcaatcatggagctgctgaaacgatccttggcctttccgcaggtactcagccaggaatatacgcttccgtcactttccctgtaccagttgtccaacagaaggacgccgtccccctggggcttattgtagccgaacatatgctcatcgtagaaattatccgcatacaccatggtgtactgatagggacgcaggcttcccagctgctcttcatagcctttggcatattcctccagagactcattcagcgtcacaagaacgatatcgcagccggtctgcttctctcttttggctatcagttcacgcaggctgtcctcttcgctgtcggtcagcttatccgcataatcgaaaaccctctcctgcgtggtgcattccgtattggcgcgctctgtcttcgcccccgccctggcaatggagagtataagaaataccgccgccaacgccaatataataataaaataaactctgaaatatttcagatatcccttcatctcaaagcacctccagtattccttttataagcagtaatattatggtcaggctggcaaaaaaagtgccgctgtaagcgaatatcctctttttacacaagggggcttttcctattaccttccccgtctgtccgttcacaaagcagtcatagttttccccttcatagctgtagcggtaccaccataccggaagcagcgcatatttggactgtatgctgtgcatacggatagtttcctgctgcgggatcagggtggtatatccccccatagtgttgtggagcatgacggacgcgtccttcctcgcgcgatcctccgcacggggttccagtacctccgccgactggttatatacctctcccaggaagccggacatatactccggccggaaattctccagagcctcatattgatacggctccatcatatccatcacctgatcctccatttccagggaagcatctaccggaagcttttcaaaatccacatccacatccctgtttacctgaaaataagaggtttcggtatactccgtatctccgctcacccatacgcgcacgattgtcccggttccggaataatggcagtccgctttcatgtcatacagccagaaggggatatagctgccttccattttttccaccgtagcctgtgacaaaaaggattccggagcaaacacacgtctggaaaattccttttccaggcacgataccgccgccgctttccccatcttaaaaggaaggatcagccggggttcataaacgccctccaccctttcatcaaaaatcgtatagtgcccgcagtattcgcatttcaccgcactgcggtaatctcccgcctctataggggccccgcagttggcgcacagctccattccgccgcccggggccttatcctgcgtttctatcccgtcacagtaaggacaatgcatcgccttcctgtccgggtcataaaccacattccctccgcagttcttacacttgtaaatcatattctgctctccttcattcgccgtaagcataaattatgtctcaaatgtattttaccattttcccgtctctctgtcttccattttgctgaaaaaatggtataatcagagtgtctgcgaatcaggcgattataccgcaaggaaaggaatgttgattatgaatcccataaatccaatgaaattattacagataagagcctcctgggagcagtttaaggccaggcatcccaaatttccttctttcctgaacgccgtatccaaaggggccgtaacggaaggaaccctgatagagatgacaataactacggcagacgggaaacagtacagctctaacctgaagcttacatcggaagatatgcagctggtgaacgatatgaaggaaatgttctccggccagcagggaaattaacggttacataagaaagcccggcgcacctttaccagcatgactggtgtgcgccgggcttttataatcggcctgttactgcatggactgcagaagctccctcataacggtctgtgacagggcctgctggtactgaagggaataatccgcaatttcctgctgaataacccccgccagatcctgtattgtaagaagaacctgctgggcctccgtcaccgcctgctgctgataaagaagaacagcctgctgtttagcagccgctacagccagaagctgatcacaaagcgctgccataaactgatactgagccgcatcccctgcattgcctgccgccagagcctgcctgttctgttcgagcgcctcttctttggcctcctgcagttctttctgctgggcagcgatactcatgagctgctggttttccagatccgcctgcttctgaggatctatattgttaagagcctctatcatcgcctgatggccggcgatatcctgcccgatttcggccgggcctttcacgcctgtcagttccccctcatcgtcaaatacaaggatggaactggcagtggcctttaccttcgccagagtggcatccatcacattgtatctgacaaaataaggatctcctgcgctttcctttaaaaactgcatgacctcaccgctggtatttcccaaaaagagaagcccctccccgcccggaacatccacaacgagaacttctccatattcatctgaattgatgagctccgccgcgtccgcttttacaggcatcaggcaaaacagagcagcaactgcggcagcagccagcgatacaaaatatttattcttcattatcctacctccattctgtaatatagtatacgttattataatactttcttacggaggaaaagacaaggataatatacaattatggcttaatgagttttcctgtgcgcaaaagctccagcatacgcgtattctgtgcggaggttcctttataatccagtatctgattggccgccgcgatttcctccctgtaatggtaggaaccgtctgccccgatgctttccagcgctgcggagagggaactgccgtggaaaacctcctccaggtaatattccgttttggttttccagaacggcatatagcatacgtccagatccaccggtgtggaaatcccgctaatactgcctttgctggtatactgccaggcgaaaaggggatggctgatcctgggcttatattcctccgagggaggattttccgcaaaggtgaatttacggctgatcggatagcgggcaatccagaacggacagtcaaaagcagacgcgtcaaaatggccggcctggtaaaatgcctgatccgtataaattccaaaatcatatcctgccccgagaatggtattctctgcggtccggatcaggccagtaagcacttccctccccagcctttccagggacttatcttccacatcccaccatatcctgcattgtcggttcccctgggactgaaggagctgtactacctgttttgcctcctccagcgcctctgtggggagcagggcatacgtataacggtacacctcataaggaatgccgttttcctgacagccccttgcatttgccaggaactgtatgtctgccttcccattttgtttcattgcgcgcagtatggcaaaccggcagcctgccgcctttaccttcttccagttaattgtgccctgatgttcagaaacgtcgattcctttatacatagcccgttctctttttccatctgatttttctttatagtatatgaaaaagaagggccgctgttccttattctgccgattttgcagcctgcatcatcctgaccgccagttctctgcccattccggcaaaatagtcctgttcctcctgccccatccctgtcatctgcgataccagcatgccaagcaatgcctttaccttttcagccgctttatccaggctgtccccctccaggtagatacggagaagctttttttcctctcgtccggcctgcagctcacggaccggacagtctcctaccatacatataagagcatgaagcagcaccggatagcatatattatccatgtacaggtttttgtaatccggctgcaggctttccaacaggccgcacaccgcctgacggggaaattgctccagcagctttttctccatggtaatatgcagaaggtaactgtaaatcctgtccacgccggaaagaggttccccgggaagcagatccgggtaatccagcgtgagtatatgatcctgcggccggaaccgggcatcgtatttcatgaaaaaggcgggaagtccttttattatggtttccctgtaattcagacagccgtaatcctcaaaatccacgatcagcttttcatacagttctttggcctttccggccttttccagcacattgagatatcctttttcgtacgcttgccttgcatgaattcccttttccgcagacaggatcccgttcgtattttgtgaaaagcattcctgtatacaataacagacagcctccatgagtgccgacgccgtttcataagtcaccgaactgctttctttggacgtatatttatccgtaagccaggccgccacgggcaaaagctcctctaactcatatcctgccgttctctcattttccatatctataccccgcattccgcaggccttcctgcgatactgtatcaaaaagcagtctggaagcgtcttcctccaaacctgcctgtctgctccaaacacaagagcgtaagctaccaaaacagttcctttaccacatccatatacaggtccttatcccacctcgcctcctggctcaggttttcatattccccgtttcctccgctttcctgatatcccctgtatccggcccggatcgccgctgcaaaacggggcaggcaggtactttccaggtactccgtatcccccatgcagatctcttcaaactgttcccgcataaaggaaagaagctcgtcgtccgtcagctgatcctcggcttcgtttttaaaacaatagaaaatatcctgcagcttttccatcgtttccttatagttttcctgattaatatactgcgaatcacaaaatgtaaaaatcagcttgtcaaggatcccattgccgaattccacacgccggtatttcttcaggctctcattcctgcagaccaccagttccttcgcctcctgctccgtcaggcttaaaccgaaagtttctgtcttttcgttgcaggccatgagaacggtcatctcttttttctctttttccgcgagtatcatttcaaaaaaattatcttccattcacccatccctttcctatacacctataccctttttacagtgtttcctgctgagaatgcttattatacgtccgccgcacacccattacaagacttgactttttccactttttatgatatgattataatcgaaaaagagatagaagcaataacgctcctatctcttttttattatctgtatcgtcctcacagccactgttcctcaaaggcttcggcccctaccggccttccgaaataaaagccctgtatcagttccaggcccattccttttaccacatcgtattcttcctgattctccacaccttccaggcagacctttttacccacatcgtggcatagctccgtgatcgattttacaaaagtggcattaaataaatcagaggtgattcccttcacaaacccccggtctattttaaccacatccacaggagtgctcttcagcgaaaataaagaggaataaccgattccgaaatcatccattgccagcatgattcccgcctgcttcattttatccagaatatccctggtacccgctgtttccttcaccagatacgtttccgtcagctccagaatcacgccctcgggcggcatctgcagtatatccagcgtctcccgtattccttccacaatatccccctccaacagctgcctgtaagacaggttgacactaatatggaaatccggttttttcctgcgccacttcctgcactgctccaccgcatggtacaaaacccagcttcccagagggataattaatccattctgctccagaataggaatgaactctgccggtgagacgtctccatatttgggacagtgccatctggccagcgcctccgcaccgcagatttttccggtgtccgcatatacctgcggctgataatggatggaaaaaccggcaaagccgtgttcgatgctttcccttaacagctccgccagctcaagcgtcctctccttttcctgtataagctcccccgaaaacatggtgatccggttttttcccttctgcttggaatgctccagggaataggtcgcaaatttcagcaaatccaggtaattgtcggcatcggagggatagaccgcacagccggcggaaatggtgcagtaatattttttgccgttaaactcctgctgcctgcagaacttattccggatattgtcgaataccttcagcgcttcgccttctttaccattcaatatgataataccgaactcatccccgtcaagacggtagatatcggcattcgacggaagcatctgtgagatcagctgtgctgtcagccgcagcacaccgtcaccgaaggctctgtcatacagatcattcacatttttgaaggaatccatatccagtatcatgacatccatactgcgaagatccttatagtccacaaggtacttcttgatgtttccctcaaatgcaaaacggttataaagtcccgtcatatggtccgtgcggtttaccttccccagattcgtgatcattcctgcaaataaatccggccagccctgggaatccttcagaagctgtcccctgcagcgcagccaaatccattcgcctcttgtatttttggcacggtattcgatattatgggaagttacccttccatcagcaatatcctgattgctttcaagaaagcttttttcatcatccgggtggatcataccgctccagaaagccgccgcattctccacaatctctccgggcagcccgaattcctccaccatggccggaggatatctgaacacgccggttttcatgtttcctacaaatatgtagtcatccgtactcgccgaaagggcctcgtacaaatgctccttatcataccagaagctgccggtcttttctccgttctgtcctttttccagaagctcttccttggcccgtcttatgctgtaatcccttttctgaagatacattttctcatcaacctgcctgatgatatcgaatatcgtataccggtcggccggatatatttccataagccctatgctgaaggatactttatagaataagccttcccttccctgcgcctcccggaaccgctcttctatttcactcatacgcttttccgaatccgcaagtagttcatcataaaaaacaaggatgaattcatcactgccgagccggaacaccatatcctgttccctcaggctgtccttcatgacagaaaccatgcataccagcaggcgatccccttccgcatggccatattcatcgtttatctttttcagttcattcacatccaccagggccatggtgatgattttgttctcctgcctggccgttaccatacgccctgcaagcatttcctgtcctgccctgcggttataaatccctgtcagttcatccgttctggcttttctggaaagctgttcatattctgtgacatccgtaaagttgctcacataataaaactttccgttccactccgcccagctgtcataatgcctgtaaatatgcccggtccgggtattatgctcatcccacacatcaaccctgccttctgcagttttattctttatatggcagaacggacattttcccgtcatccccttctgcagcagctcccagcagggactgccttccggatgctccagatgaaactcctctttcatagcttcattcatatatacaatcgtatccgtatccacatccagaatataaatattggtctgcagccggtcaaaaaccgccgcataaaacagcgcatcaaatccatccatttttccagtatccataaagctccctctgttatacataccgttttttacataatttcattgtaagcttttacgatctattgtacaagtatgaaaaatttttttcttatcttcttaaaatattattgcccatgggaatccatggacaataatttcaaagcctgcagaaaatatttttttatctgcgcggcctgcggccgccgctgtaatctctcgttcttccgcttcttcttctctttctccagcggtatttccatatctgccggcgtaccagcatcaccgcgcccgtaacgataacggcggcggccaggatgcccagcggaatataccaccaatggaagcctgccttaccgtccttctcctctttggccggctggctttctgtttccgtctccgtttccgccggttcctcttttaccttcaggaaatcgggaaggttaatggaggcctgccctacctgatgggtgccgtaggtatattccagcgtgccggtctcccctctttccgcttctgccgcaagcagaagctgcggctttaattccgaaaaattcaccctggacggaatgatcacaaagccatcctccgccatctgtacaggcactgtctccaccttttccgtaccgtccgccgcctttacgggcacttgaatttcagcggcctcgctcgtccctatatccacttttttaaaattatcgaagcagaaatcaaacagagacgccgtgtccacatatacctgacggccctccgtcttcatcgtcacgcagatgagttccatatcatcccttgccgcgcaggtgaccagcgtgtttttagccactaccgtataaccggtctttcctgcaaatacgccgtcataatggtatttgccgctgcagagcatcttatggtggttggacataggaatgagatccggctgtttatccgtaggctggatttcataatatacggtcttggacacggtcctgaaaatctcgtgcttcagagcttccctcgtgatcagggccatatcataggcactggatacgtgcctttcatccggcagcccgtgaggattgacgaagttgctgtcctggcatcccagctcctttgcccgcttattcatcatatccgcaaaattctcgatggtgccgcccacatgtacagccagggcgtaggccgcatcgttggccgaagccagcatcatgccgtaaaggcagtcctccaccgtaagctcctcaccttcgtcaagtgcgatatgggaacccttgtcatccatgtacaccgcttcgtggggaacggtaaccatctcgtccagctcgcagttctccatcgcaagaagggccgtcatgattttggttatactggcgggataataccgggcatgcatatttttgctgtacaggatggttcccgtggaaacctccatgacaatgcccgattccgcaacaacggacggccccgacggccagaatatatcactgccgtcctcaccgctttcaccggtattttcctgctccgcttccctttcaccggtttctgtttcctgtccggctgccgtttcttcgccgccttccgtattatgcaccatttcatcttcaattgtactgatggtatttcccgacgcaaatacgttcatcggggacgaaaaaagaataaaagaagaaagaattaccgctgtaactggtttccatttatatttcatcagggggtatgctccttgcagatttctaacattccaaaccctcaggcctttggctcatcggggataataaaactctcaactaaaagattacctccccgtgaatatcaagtcaagcagattatcacccatttccgaccaaaagtaacttttttagcaggtaatttgtggaaattgcgggtttttaccaattcttaatttttcgtgaagatgtgaattgacaaataggttcacagtctctatactttctatatattacaactgtaagaaaggttgaggtattttatgaaggctctccctcagatatcagaagcggaatttcaggttatgaaaatcgtatgggagcatgcgcctgtcagcacgaaccaggtaacggaatatctgacccggactaccaaatggagccccaaaacgatccagaccatgctgaagcggcttgtacagaaaaaagccctcacctatgataaggagggccgggtttttatttatacgccccttatcgggcatgaggattatgtgaaccaggaaagccgccattttctgcagcgcttctataacggcaatgtggtttccatggtgactgcttttctggatatggaagagctttcccaacaggaggtggatgagctgaaggagctgttaaccgcacattcctcctagcgtccatttctggccggatggctcaccggccgtattgagttctgagggcatttccgcactagtcaatatattccctcatatcctttactcctctccgctggcggaggctcttaatggccttgccctcgatctgccgtatccgttcccttgtcacgtgatacagctttcccacttcttctaacgtccagttcctgccgtccacgaatccaaaacgcagaagaagcaccgtctgctctcttttggaaagggtttccagcactccgagcagctcctcatggatgattccctgttccgcgttccggtattgctccggcattttatcatcggaaataaaatctgccagggatgtatcctcttcctcccccaccggggtttccagtgaaatggtatcgccgaaatacttcatggtttcctttactttttccactgagatgccaagaagctgtccgatttcctcctggtttggctcccttcccttttctgacaggaatttgcgggatacccttcggattttattcatactctccttcatatggacagggacacggatcgtcctcgcctgatcggctatggccctcgtgacggcctgacggatccaccagatggcgtaggtgctgaatttgtagcccttatggtaatcgaaacgctccaccgctttcatcagtcccatatttccttcctgtatcaaatccagaaaggccatgccgcttccgggagtgtacttcttaaccacactgaccacaagcctcagattggaatgaatcatcttttcctttgccgcttcatccccccgctccattgcctctgcaagctccagctcttcttcaggggaaagcagagggaatttgcctatttcctttaaataggtttttacggaatcctccgtcaggaacttgtcctgcagcgcggactcggcgccctcttccacgttatccggcatttccctgccgtcaagggcaggcatttcttccggtatcttttcagttttgcgggtatcctctgccagttcaggcaattgcttctttcccaacatcctttcagcctttctttttatttatgtatctttacagcttcgtcattccagactcggacactccgcctccacagctatgaaaacacagtccttttattggataaatctggctgttctatatagaaatattcccgtaaatcgcggctctatacctttcacggcataaaggaatgccgatttttccctgcttttccataaaaaagcactccggaacaattctgccatttgtttcggagtgggatttcttactctaagtatccatctgttttatactggttgtactgtcttttgattttaaccacaagagcgcctccgggttggaccgtcttttcctcaatagcatacgctgccttcttcatatccagctttttgcagtaaatctccagctcctgctccggattttctccattcagattatcaaacctcattgtctgaagcagacatgcactcgtaattcttctcattttaatacctcctgcgttttttatatcaggtttattttatcattttattttttttaatgtcagttaattttttcatttttcagtattttcagccaattgcaccatatatatacaggagataattatgtattatgcacaagacaagtcctgttatcgcttgaccagcctgaataaaaaagccctccggcccgcctattttccgggggccggagggctatgtatcacctctcccatcgagtataaaactgctcataaaaatcttctgttccgctgtaaggcgtcagataacaggtctgcagcagctgcatgttccgctgctttatccacgcttcatctcctgaggtttttatttcctcctggagagactttacaaagaaatgccaatggctgacaaactgttcatagcggcgtatctcagggatatccagccatttcttgattttcattttagtccggctctccttccggcattcatggacctgaagaaaataacggaagctttcttccccatatatccttcccagagggaacaggcggcacatgccgggcctgaagggatggatgctgcatcttcccgcttcattgaggaacaggcagccttcctgcggcccctccaggcgcagatgaggcaggatcactccatcgtatacggaaagagctattttcccttcccccatcagctgctcaaacgtacagtgaaggttccccgtaagctgccagatatcatagggatccaggataatagtatcccccatttcatggcagcacgccgaacagcccgcacagtccccgcagccaagcttaaccaaatcattggtttcatataattttccgtcggatatttcatccagattaatatctcgttccataagagcctcctcgtttttcaggcaggcttccggcggaaaacgggaatatccccctgaccgacaccgaaagcaaaccttccgctatcaggaattataccataccggactgattttacaaagaaaaggttacgcgccagtttccctgcacgtttctgcctgctttgtaaaagcttccatacagcttatactttcccagctcttctttggggatacggaacaggaactcctgatagtccacacgttcctccttctcttccataaaagatatggaataataagaatccacccgttttccttcttcatccatcagatatagaaaaccatgaggatccagtgtggttttatccgtaaccgccagctggatatgcagcatatcccccagatagccggccgctgttatataaattttatccatgggggaatccagcatttcctggggtcggagaactattttaggaaaatcttccgcttccatttcttcgggcgtttccccggaaaatccgtagccgttaatccgcggttcctccataaccgctgtattttctctttccgccagctgcgccggctgcagatccacaggcacatcttcgtccgccgttttcccgctgataaattccctgacagaaaacgtgatcttcccgccttcaacaggctttccatccattcttgtgatttccacaaggaaggtcaccttcccggtttcttcctcataggataccctccggcagcttcccacactgtcaaagcttctccttatggaatagctgtcaaataaatccgtcgttgcatcaatccgatctccttccaaatcccggagagaaacatagagccgggccgtatcaccctggacataggccgcttccacctccatccggattccgctgtcttcacaggacttccggacagggatgaaaaactgtgccgtagcgggagatatctgatacaatacatgataaaaagccggtacttctgccgccagcaggggcactcccgtgaaaaagcagaaggccagcagtacggcagcagccgcagttttccacagccttccttttcggcttattctatttttcttatctgtctgcaccaggatctcttctatataagaatctcccacctctcccagcgcctcccacaatcgttccgccttcatatccaaatccccctttcttccaggaatttcctgagtttcttgcggcttctctccaggataaccgcggcgtggtgttctgtgaccccgcatgcttttcctatctctttcaaagcctgtgcagcccagtaccgtctgagaaaaattgtcctttcccgttttcccagggtatccaggaactcctccagatatcctgacagctccttcctttctatctgtgcctctacctcccgccaggccggagccggtatacattcctccagttcttccagcaggcagtcgctgcggctatcccttttcgccgccgtattggatcggaatttcttaaccgcaagattcctggctatcctgcatacataggcacgcagcacagcgggccgcgcgggaggtatgctgttccatacgcccaggtaggtatcgttaaggcattcctccgtgtcctgctcattttccagaatatttcctgcaattttcctgcacagcctgccatatttcgcggcggtttcctctatcgcctgttcggaacggctccagaacagcgcgataatcttttcatcctccatttcctactccctcagttcccggtcctgtatgtcaggacagtgtgtatgtttctgtcttcccttactaactacccttatgtaataacatatcacactctgattcagcagtcttcctgattaattgcttccgccgccacactccctcccctgacaatttcgatccggcccggataatctcttttcagcctgacgatcagttcctcattctgctcctctgactgcacactctccaacaggacagacgaccggccatagtctgcgaccctggttcccgtcacctgggaaagccggaacagctccgttatttccttatcggaacagcctctgattttgacatacatcatttcctttctgcatacggcacacccggtataatccaccaccttaataacctcgatacagcggttgagctgttttttcacctgctcaaaggttttgtcgtcgctggtgaggctgattgtcatacgggaaaccgtttcatcctccgtcctgcccacggtaaggctgtccaggttgtatgctttggcggagaacaggcctgctattctggcaagcacccctatttcattttccacgaaaagacaaatccatctctttttcatacccgctcctccttctcattcaaaatcatctcctcaagagtttttcccggcgggacaataggcatgacattttcttcccagtcaatgataaattcaatgacggtggggcctccggctgtctgctttgcggtctgtaaggcagaagcaatttcctcttcctgcgtcacccggattccctttgccccatagctttccgcaaggcgtataaaatccggcgtataagcgggacaatccttaccgggacggctgcagtcagaaggacagcttttccggtagcgcatgcaggtggaggcgtacctctttccgtaaaacatttcctgccactgccttacatttcccagataaccgttgttccatatgcatatgatcacaggcagctcatataccacggcggcagccagctcttggatattcatctgcatcccgccgtctccggcaataacaaccacatccgttccggggtttcccagcttcgcgcctatccctgccggaaggccataccccatcgtaccaaggccgcctgacgtcagcagctgtttatgctcgtccaattccagaaactgtgtgacccacagctgattctgtcccacatctgtcgctataatagcttcgggaaaggtttcattgatatgcctcatgattgtctccggcgtcattcctttctgcccccgctctatgggatgctgtttcttccattttccaatctgctctctccacgcccctgtttccagaggacaggctctttcacgaaacgcgtggatcgcctgtcctgcatcggcaacaatcggaatatccacggaaatattccgggatatggaggccggatcaatatccacatggataatggaggccccgggcgcaaaactgcccggctttccggtaatacgatcattgaatcttgtgccgatggaaaaaagaagatcgcaccggctgactgccttattggcggcatatgaaccgtgaatgccgatatttcccacatacaaaggatgtgtggtgggaatggcgccttttcccataatcgttgtgactacaggaattcccgtggtctcggcaagataacgcatttcttccttcgcccggctgataatcactcctccgccaagcaggaaaagcggtcttttggcctgcttcaatgcctccattgccctccggacctggcctgcatgtacgccggtcacttgtctgcagcctcttatctccacattttccgggtagctgccgcttccgtattctttttgtatatctttgggcagatccaccaccaccacacccggcctgccggcttttgcaatcacaaatgccttctttattatgccgcccagttcctcccgtttcctcaccgtaaccgtatatttgcatatacttctggtgattcccacaatatccacctcctgaaaggcgtcattccctatcaggccggtgggcacctgtcccgtaaaacagacaagcgggacactgtcaaaattggcggttgcgatccccgtcaccagattggcagcccccgggccgctggttaccaggcatactcccactctgcctgtagaacgggcatatccgtctgcggcatgaatcagtccctgttcatgccgcggcaggataacatcgatttctttttccccataaagaacgtcaaacaaatcaatcgcctgtcctccgggataggcaaagagagtatttaccccttccgccttaagtgcctttacaaacagttctgctcctgttatcatcctgttgctcctccttattccttatatttaaatgcaagtacttgcatgcattaaccgtatttttttggtactgcttttgcagtaccagatttttcgttcctattacagttcaatcaaaaaactaaatttatattgaaatgccattgataaacaaatccacgctctttttaatgtactccgtttgttccagcttcgtgagctcctgattaaaggaagcctttaaaaaggtaaaaccgaaggtggaagaaaaaataaccatggccatactctcaaaatcggccggagctatttttcccctttgttccatttctttcagatactccgtaagcgaagacacaaaggcatgaggtatctgcatgatcagcggcgcggtttccccataaagctgaggcgcgcgcagtccgatggaaagcttcacaaaatccggcgttattctttccatatatgcagtcaggaacatttccagatccgggcgcagctcccacctgacatttttaaatatctccggggtcacattggcacgccatttctcctgagtgatcccctggagcacgatatccttcttattgccgaacttacggaacagggtacattcattcactcccgccgcccgggctatatccttcgtggtcgtggctacataaccctgatcacggatcagagtcatcgcagcgtcaataattttctggcttgtctcatccatatcgccacctccatgcaagtgtatgctttcattttattctcatttttcctctctgtcaatccaatcctccgaaacaggcggcaggatttgcggcttgcgcgggcatgccggacaccgtatacttggactatacaggatacaccaatgtgccgcataaaaaggaggctctgcatgaaaaaacgattattgtatctccctctcctactctgcctgctgttcttaaccggctgcgggcaggctgggaacgaaaacctctcagctgttgaaacctttccgctcaccccttcccgtgaagggacagaagctgttacggctcttattgaaaagctccccgccggttatgaagaggacacctgtttcaacgtgaccccggaatccatttctgagaaatatggcttcaccatttataaatatgattcctcctgtgcctcttttctcatgtatgaggaagcagtatatcctctgggagaatggttcggcggatacggcgccacttcctttgccgtcgccgatatgaacggagatggggaaagggaagtctatttcaccttttcctgggggtcagggatacaccgttcccaaatcggctactttgatacggcggacaaaaccgtgaccgttttcgattactctgattataccggagatatggtattaaaaacagacggcaaaggcagcctgtatgcctgccatgccgtctgtgacgcttcttcctttgtggatatccaattgacaggtgaaacaaaggccgcttccatcgtctgtgaatccggacttatttctctggttccggaggaagcttcttcctcgacagaaggataaaatatccaagacataaggctatctggacaatggaggagcagggggtagccagccccaccttaaacagggataccggcttcagccggctcatgaaaagagatacgggaattctgacacagaatgcccccacgattccctggatcatgacaaacagcgttttctggcagccgttgaaatatcctatcatacagaacataatggataccagcagacagtctatggcataagccttcagatattccgcggctgcagcaataacggcggcatccctggcaaaaagccccgccagcagatctccgtggaaaaaggcgagccaggccatgaacacccccaccgcgagagaaagccccactcccgtgaacagtgcctttttggcccgttctgctttgcccgcgcccatattctgcgctacaaaagcggacatggactggttaaaggccgacggcacgagcatgataaagccgcacagcttttccgccacacccactccggcagagggtattacccccagggaattcacgatagcggtaatggccaggaaggatatgcttacaagcaaatcctggaaagcaatgggcagaccgagacggaatacgcttcccatcctctttttatcgaaaacaatatccttcctgccaaaagaaaagggaagcttcttcttccgtattatcagtatggaaataaccacactgagcgcctgggcgcacaccgtggcaatggcggctcccgcagttgccagcccaaatacgccgaccagcagaaaatctcctgcaatattaaatacacaggcgattgccaccgttatgaggggcatccgtgaatcgccgattccgcggaagatacttcccagcacgttataggctacaataaaaagcgaacctgccgaacagatacgcacgtacatcaccgtagcatcaaatgcttccggaggagtctgcatgatccgggcaaccggtactgcacacagctccatcaggaacgtaatcacaatgccgataaggaggaataacacaacactggccccgatgatttttcctgcttcctccggtttgccctcacccagctttcttccaagcaatacggtagtccccatggcgatacccactacaaaggaagtgatcagctgcatcagccagcttcccgtggaaaccgcagaaacatctgccgctgcggcaaactgccctaccacaagcatatccacggctccatacatcgtctgaagaaacagggctgccaaaacgggcagtgcaaaacgtacaagggataaaaggatgtttccttctgtaaaattctgggtttctttcattttgatttcatctcctttattctctgcagtatttatccaccagggcagcacaggacagcttcctgcaaatgcggttttatgccgacaaaaaaaccggacaagaagcaggcatctcagccagcatcttatccggttcccattttccaacgaatggtccacctccgatgaacgatgttattatataatggacctttttcgtttgtcaatccttttccttattagcgtttccttattaacggcagcacggatgttactgtttattctctgttttttgcaatttctgcggcataatatttttgtttagaactctttggtttatccggcagagtcatattaatatagcctttttcaatcaagggcttcataattttattcatcgtataataccttgaaaaaccaacaaatccaataatttcttcccttgaacgcggaattttacaatattccagaagtgcattatcccgttcgcccactctatggaaaatccggtcagactttctattcatttcctgtccatctataaactcttcatagtaaactatggggagattatttcgcagtataaccttaaattcaccatttctgacagagaactccggtttaggtaaatttgctttcatcatctccttttgaattgtaggaataccagaataacgattttccgtttctcccagaatttccaaaatattagctaaagccgggttccgtgtctcaggccggacctttcctaataaatccacagagattctgccatacagtccccctttattcgtaacctcaatccgatcattatacatacagattgttataggcgtcccttcagtatggatactataatcacggtgtataagggcattcagaatgacttccctgacagccttcattggaaattccggcttgtcatttcgatttccatcctcatctatcacagtttttattctgctgtttcttttaacaaactccacagctccatgaagcatctcactgattgtgccgtttattcgcttattggatataaaacgttcatcatcactccccgtatctcccatctccgtacccggaaccactaccgctgttattccaagctgtggaaaataagcctgcggatacttcccgaaaacaagaactcctgataatgtcgggcacccatttgatgttatacccatcagttccagaatttccatatccgttatattatgagataaattctcacgttcactttttacagcggcaagataagactgtaataaatcttcctggaataaactcgttttcgctccttcgatcacacggatatcatcccggattctgcgtctgaatgcatcataggtatagatttcatattcattcatcggttcatccgattcaccgacgcgtacaaatgaacctctctgccgcccggcacctttataaaaaacaggacgttctgctacgtccactcctggtatctccgcagaaacaacgaatttcccatcaagttctgcaacagtaaacagcggcctgacttccggttccatctgtttacattgttccgccaccttatgctgcagatcctgtatatcataaacaccaactatgttaaaatgttctttctcatccagtccaaataaaatgataccgccgctatcctgatttgaaaagcttgaaagactgtcatacaatcttgttggacagccttttccggcagatttaatttctattgtctgaaactcacattgataatgctttaccttattaaccaactgcagcaattcttctgcctgcatagcaactcctcctgatttggcaactcttttaatcaattatagcaactcagtttccaaaaatcaagagtttgaaaactaagttgctattcttaagttgctatttgaaatcaccttccgctttccagatttcccgggagccagcccttctccacgcatttccggaaatcccagccgtccggttcggatatcagcttatagctccagaagaaataaccgctgcctgcctcccaggccatgagctgggcatctcctataagcttataggaaagctgtttttccagttccgtatactccttatccggcttcagattatgagccaggcaccattcccccacaatgacgggaactgtcttctccatatttttgagcttttttacatcctccttgagaatctctctcatatattccagttccgatgtatcctcgtccgcaattcccatgccaaggtaccagtgggcatccagcaccacattttcaaaaccggcttccctgaaaaagggttcccagacttcgaagcggaagccgtcatggaacacgatctttttctccgccggcagaatttcccgcagcatatgataccctcttgtataaaaatcgtacagcacctccagcgggacaaaggaagagcctgccgccctctccggattatgaggaagatactttccccggatcatctgccagagggactcggaaatcggctcattcagcagctggattccccagagggaagggcgggaaccgtaacgcagcgccagcatttccagcaccttcaggacacggtccaccttttccggatcctgcgcccatttacagaccccgcagatccctccgttgtcaaagccgttctggctttccggtgcggtatgtaaatcaatcaaaatggaaaggcccgtttcctccgcccagtcaaacgctttgtccagatattcgatacacggcacatagggttcacaatagacgggatcatccccgaatatgaaatgaggcaccgggatacgcaccgtattcagcccgcagctgcggatataagaaaaatcctctttggtgatatagctgtcccgatgtgcggtgagcctctttaccagttcctcccggggaagctgccggcacagctcatcctcatcctccgccgatgttccttcaaataacgccggatgcatccatttttcaagcaccagccagtttcccagatttactcccctgattttatccattccgctatcctccttaatagatatattgccatgtctcccctgtccggccatactgttgtcagaatacaaaagtgacaatgctgtgggcaggaatcttgtattccgctattttttcatggaaacgcaggattgtcttcttctcctgctcaccgggattcatcgccaccaccgctttgcttccgtccgggttgcggaatgcacatacctcaagacccggcgtataaactgagcttccgatcctttttgctccccgtttgacaaaacggctgaaatggccgatgtaataataagaagaagcatagtgaaggcttttctcaccatggtcgcacagaatcggtgactccccgaaccagatcccctcttccttcatcagcttttggaaccgcggatccttccagtttatttccaggcccagttcctgtctctttgccgtaatccgttcccaatgcagctgctcatccagccagtgatccgggccgccgttttcatccagaagcatattccagtctgtccaggcgcccacccagttgtttaaatcccctatgatatcatgggcataggcttctcccgattcccagggcagttcctccctgcctttgcactgttccgaagcgatcagcagcttctccgggaaaagacgatgggttacgtccagcgctccgaaatgatcgccggaataccagtgcacggcaataccgtcaaaggccgctctcgcccggttgctgcacagtgtttccagactgcgatccaccactctctctttgttatgatcccagaaaaaaattttcttgtcacccagcccttctctttcataggccggcttcaggtaaccggtcacaaaatctcgttcttccccggcttcataatggcaggattcccagccctgctccgccttggcttcattctgtacggtaacgccccaaatcgggatcccctcttcctcataggctttgatataacgcgccgtatatctggcccatgcatcctggcattccctgcgcagaaagcctcccttatccatttttccgttggtcttcatccatgcgggcggactccagggagaggcaaaaagccttaaatccgatgctttctcttttgccgccagcaccatgggaatcacgtcttccttatctctttcaatcgaaaaatccttcagttcgtaatcttccggtgtgtcgtcataggaatacatttccgtggaaaaatcacagctgtttatcgtgagccggcagaaattatagccgatgcccttttctttatcgaaataagcttccaggacctcccggcgctgactgtcggaaagagccatgaaattcaccgccgacgcctgggtgaacgcccctccgaagcccattatttcctgatactccacctgatcatatacattcagtacattgccttcattcccgtcatttccgggcttatcctcttcaaaacgcagccccgcctgctcctgaagctttttattgttccccatctgcgtcagatataacttaattgtctgttccatcctgtcctcttttccccggcccctgccggatcaccttttaccccatatctatgatatcatttcttttctgtctgaaaaggcggcggaaaaaatttctccgccgccataattctcttcttacttccgcgcggcctttacaagaccttcttatgccttattttactgtccgagtccggctatgtatgcgtccagctgctgctgcagaacctcgcgcaccttttcaataccggcggcttccatcttctcctgatactccttcagtccgcttaccggttccgtgtagcccagctccagaggccaccagtactgctgatgtacgttctggcaggccgcatattctgtttcgatggaggaagtatccagtacgaaggaacggtatttctggcttcccacaccatccttgatataagcatcccattcttttttcagttcaatggtacgatccggtgtgccgatcccgtcacggttcagctccgtggtacgtgccgcccacatggcggacgccgcatagttgtcgggatccaatgttttcacttcacctttatcattcagttcataagatacgccttcaattccatagaagaatacatcaaaagcttctctgtctgtcgtaatcagttcccaaagcgccagcgcccgttccggatgcttggaggtattggaaataaccatggcgtcctgggtaaatgccatattggaaacatccttcaccagattggcataatcgaagctgtattccggcttgtcaatgaccagtcctgtaaaagtatccacgttatgtactttaagggccgctttcccgtttttcgttttatcggaatcggtatcggataaagcggatttgctgaagaagcctttttcattccagcgattcatcatttccaggaattccggtgttttttcatattcataataggtaaagatcttgggattctcttccatgggatcaatgaaaaggaagtcattggaagaacctttcagagaatataccccattattccacatgtacaaatcatccatttccgatccggaggaatacatatccaaaggttcaaactcaggacggttggcctttaccagatccatgtattcttccatatcctcaaagctttccatcttaccgtcccaatccgtgccgtcaagaatatcggtacggaacatggggccgtatgcggaataggtcgccagcaatgtgggaacacagtaataatgtccgtcaatggtcgcctgctgcttggctgtttccgactgcatcgcataattcttgggcgcataggtcggccacaaatcatccagattcatgaaggcccctttctttgcaagcgctgaataattcagccatgttgcggtataagccatgtcgaaggcttctcctgaagaaaaaagcagcggatatttgtttgcatattcagcccatccaatgtaattaatcttcaatgtacaattcagtttttctttgaacagtttgttcatgttatccgtcagttcctgctgcttggccggttcattgctgattacatacatcaccagctccacttcctccgaagtgtccagtcctccttcctcctgtacctgcgtctgtgccgcagaatcagcggctgttcctgcagaaccgctcccgctgcctgagctgccgctgtttccgcagcctgccagcagagttcctgccattgctgccgtgagcagcaaagaaatcagtttagaagcttttctcatgttcataatcctcctatttatatagcttttttatcggctcagcctttaacggaaccgattgtaactccttttacaaaatacttctggacaaatggatacagcaggataatcggtcccgtggcaacgactgccatcgccaattttaaggtattagatggcaggctttccacccgtattcccgcctgacttgcaatccgggccaatgcctgtgtctgctgaagcagatcataaagcatatactggagcgggtatttttcagaagtattcatataaagcatggcattataccagtcattccagtaccccagcgccataaacagaccgattgtggcaagccctgatttcagaagcggaaggacaatctgcagaaaggtccggaattctcctgccccgtcaatctttgccgattccaccagtgctatgggaatagcggaaacaaagcttctcataatgagcagataaaaaatatttaccattcccggcaatataagcgccagcagattatctttcagatgaaggtactgaatgtaaaaaatatatgtactgaccatccctccattaaacagtgtcgtaaagtagaagaaaaaagaaatcgcgttgcggtatttaaaatcttttctgctgattacgtaagcggccatcgttgtaataaaaagtccaatcccggttcccactgccgttataaaaatagacaccccgtatgcacgtactattttttccggatatttaaatacgactttataggcttccagtgtaaagtctttgggaagcatgccataaccggtaaagcggattgcctgttcggaagaaaacgatcccgaaaccagcatgataaagggcaataaacagatgagcgccaccaggcctaccaggatatagcctataacattaaaaataaccgccgccgtccccatctttacttttcgggattccataacctgtttttctgccataaatgttccctcccttcttagaataatgcataatcttcatcaattttcttaaccaccttattaaccagcatgataataataaagcagagaatagactgatagaaagttgccgccgccgtcattccaagattggaattctgcatcagggaacggaatacataggtatcgattacgtccgttgcattatagagctgcccgttattgccgactatctgataaaacatctcaaaatcgcctctgaggattcttcccacctgcaaaagcagcatggtgatgactgtaggtttgatacagggcagtgtaatataccagatacgctgaaaaacattcgcaccgtctatctgagccgcctcatagcattccccgtcgatcccggttattgccgctatgtatataatcgaattgtaaccgcaccatttccatgcattgaagcagcatataatgatgggccagacccagggcatggagtagacgttgactttttccattcccaatgcggtgagccatccgttcataagacctgtctcataattgaaaatgttgtatacaaacgcgcctacaataacccaggaaataaaataaggcagaaaaataatggactgggtcacctttttgtaaatctttccctgcatctccgaaatgataatggccaatacgattgcaaggccctgtgaagtgatcagattcagcaggttgtacagaatcgtgtttttagttatcagccagccggtgccggaggagaacagataacgaaaattctccagcccattccagtcactgccgaacacccctttgtcaaaacgatagtttttgaatgccagtatcagtcccgacatgggaagataggacaataccaacaccaggagcactgcaggcagcaccatgagaaatagaaccctgttcttcttcatttcgcggccgaagtttataaagcgctctttcacccttccatctcccttcttttcgtacgttttcttgatactatgattatatatttccgaagacctaattgaaatatgacaaaactgagatttgcaggattattttacgcataatgtgcattttgtataattattttatgaattttaagttttagtccgcactttacctttttaatctttttaggatatatcattttgtatattaaaataatatttttcggcattttctcttctttttgcgcatataaaaccataaaaaaacggtacaaaccccttctacgggagttcataccgtttctcatctccgctcgctcctactgcagttttctttcggcttcttccggcgtcatggccggtattcttaccgtaactgtcgttcctttcccaatttcgctttcataaaacacgccatattcttctccgtaacaaagcttgatacggaaatttacgtttttagcaccgtaaccatggctgacatcataactgttttcctcgaaaatccgttctatctgctcccggctcatgccaaacccattatccgtaatccgaaaaacaagatcctgtccttcgcatgctgcccggatatgtatcctgcatgtctccctgtcgggagcctttgcaatactatacataatcgcattttccacaaaaggctgtagaataatattgatgcaggccagctcctccacgccttcatccgcgtcaatctgcagatgaatggcattatcaaagtgatagttttctattttcacgtatgccctgacatgattcagttcctcctccacccgcacaatctgtctgcccttattcaggctgatccggtaaaactgtgccagatttcgggcgatttccatgatctccggcgcattgtaatccatagcctcccaatttatcagatccagcgtattgtaaaggaaatgcgggtttatctgggcctgcagcgcgcgcagctccgccgttttcacatttttacccagacggtactgctccaacatcaatttacgcaattccttcgtcatatagccaaagctgcggaacagctccccgatctcatcgctttcctccacttccatatccagggaaagctgcccgtcctgtacctgtttcatccgggtattcagcgccaccagccttttcgtataatacttccccaatacccatgatatcaaaaaaatagacagaacaatcagtatggaaaaaaagatgagtgtcattcccatcagataagtctgccggtaaaaagcctgcctgggaataatcgataccagcgtccattccgcctgctccagattctgctgccggaaaagataagaggaattacctatccgcagttcctgccacgaagcattgcggccgtacccgggcaggtttccgctttcggaaagcgcctccatattttcccggctggatgccgccaggatttctccccgttcatcgatcagatagctgagccccttctgggtgatatcggaattaaccacaatccgctccaattcatctgccccaacactgactcttgccacacaggcgctgccgtcacccacttcgtcaccgtacacttttttcagcattgcgactctctgctttttcacacccacgatttccagtccgctgcgctccagtccggtaaagcctataagccccttatccagccgctcacacaagtccgagtagtaatcctttttttccaaatcggactcgggaaaaaaatgataccggttccaggcgtataccagttcatccggtacatagatcccgcactgatacattttgttggaaagctccagcgatgtcataatatcattaatgcgccagtaatccctccactgatcccctgtctcctgccttccccaatagtcgccttcacgcagcatgtcctgcaggttcctgtccgaacccaccagttccagaatataattcatattctgcagatgattctgcaggaaatttacggcctgctcaaaggactgatcggcggaatacatgatttgttcttcataccctgattcaataatccggtagctgacggaaagaaggaggataaaaatcaggatcatgggaccggaaaaggataccgtaagctttattctcattggcagctggcggaacttgactttcatttgattccatatttttttcaccggctcttattctccctgtattccgaaggcgtcatccccgtctggtttttaaatatcctggcgaaataggccgcatcctcataccctacccgatccgccacatgatacagcttcaggctgttgtccctcagcaggagcttggcctgttcgatgcgcaggttcgtcagatactggttgatagtggttcccgtcctgcgtttaaaaaggccggaaagataagacggggtgagatatacggcatctgccaaatcctttatacacaggtttttatccggatatttctgcttcatgacctcgatcacctggaatataaccgcatttcccccgcttccctccttttcccgttcttctattgcctccatagcccgggcggcaagaaaggtatgaagctcctgcagcgtctgggcattatcccagaaacggttattttccttctgttccttccccgtgctcagcagctccttttccagcctgagtacatgattgtaaagcaggaaatacatgtttttcacagagctgttcagcgcagccttctgatccgtgagatcatcataaatgtccttcaggatgcgtcccgcttcctccttatccctcctggaaagggcgtttacaaaagcctcctccctctccctgtccagttcaaaatgtctgtcctgcgcaacctcctcggagaaagcgcaggaggaaaagcctttataagacaggctgctggcggactgacaggcggactcataggaagcataaagctgctgcggctctcccaccatccttcccagggcaaggaaatgcctgaactctccttttgattcctccgccagggcgcataagctccgtatcagaccgctgtcccgttccagcctttcccttgcttcggtaatcagaaggatcagggtccgtttatcatgaaaatcagcgctgcagtaaaaatgagcgggttccataagctcatgaagcgcttctctgtatgtattcaggaattccctcccttcactcactgtcccggcaagcttgacaatcccgatacgcatccgggtatctgttccggtccataaaccgctctttcgcagctggcattccagcttatccacatcccccggtgttgacaaaagagaaaacaagacctcttttttcaggaaatcgaggctttccgtatagctttcctgcagatccttctgtgcccggatctgttcaatcctctcgattcccttttccaccgcaccgataagctcttccggcaccacaggcttttccacatattgtatggctcccagctcaatcgccgccttcagatattctttataggaatagctgctgacaaaaataatctggcagtccggcagaaggctccgcagctgtctgcacatttcaatgccgtccattcccctcatcttaatgtccgaaagcacgatgtccggctgccacctggcacatatcccaaaggcttcatccgcgctttccgccgtttccaccatatccacgcctatctttttccaggggatgtgccgcatcagcccccgtctggtgatcagctcatcctctacaataagcagctttatcataacatctcccctttccggtcatttccctcatttcacccggattcttttttattataacacacctgtcttaccgatggaatctgcataaaatcaggccatgcatatttcatgcatggcctgatttcaaggcaaataggcggctctgtccgcgtaaacgcagctattatgcttttattattcttaccgggcccagcaatcccgtgggttcctggggcatggctctgtcaaacacattattgccccgttcctttgccagcgtgttcgccaccgtgaccgtaagctgattcttccctgcatgtatcagtcctgtcacatccagacgatacggaggacagatacggatacccgcccggctgccgtttacaaaaacctccgccgtctcatatacactgcccaaatccagataatattttttctttccttcatcctcctgcatatctatggaaaagtccgtttcatagcagatctttcccgaatattccggaagaagtcccggtaccgccagattacagagagacgacagttccagctgcttcctgccgccctccggcacattctgtatgtagattctgaatgctcccgtaagtgtttctgattcggaacacggttccggcaaaactgccgggtcttcatatatttcctgtatcccaaaaagttctcctgccaacaatcccgccttctcctctgtctgcccgcagaaggcaaacagggactggtacggctccagaataagttcccgctgtgcctgccctgcttccccttttgttccatccttttcaggcaggcagctgcgaaagagcctgttttccatggcatcataccataacagtttttccgcttcaccgacagaaaatattgttctaaccgttttatatttgctctcattcacaaagaaaaacagggtgcccgcagatgtttttctcttcatgacactgagataagggaagcttccctttatctttactgcagtctcttcctttctgaaatactccggcagatcttcatatgtccgaatatatacgttttcctgtccgtgcagtttcgtaagcagcctggaatccggtttaaaatagatcctctccggataatcacgcatgataagaacagtgagcccgtcttccgcaaggcgcagcagctctctgactgtcgtttccggaagcgcctgggcatagggaacgattaacgcgccgtagctttcttcatttatcgtgagcttcccatcccgcaccgacgcccgattttgcatcagataatccgcaggcaccacatcgcagtcaatctgtgcttccgccagtgcttttacggctgtttcaaacggttcgtattcccctccccattccgcctcggcatgatacaaaacggctgcatccgctatatgctgtccttccgacagaagggcgcaaagcctgttggcatagtctgaccacacatgaaaataatcccactgcgggttctcccctctcgcgtaaaaatgcggaggacagtcctcatctttttctttcggggaaaaagcatgggggatcagccggttgattccgcgcacgcagacatgatccgtcagccatttcatcagcttcagcccctcctgccagccataagcgccaaatatttcacagacggttatccccttctttttgggatccaggtgagccagtgaagacgccattttaggcaggccccaatagtaaaaataagaatccagatacccgaagggagtcagatgccttccctgggtatactccggccaaatctggtacaccacatcaagacccgacgcatccattccctccatggcacggaagaaatgcccgcatccataaccgagacgcgcatgtgcgccgttatcctccacaacatggccaatcagctttaccttgtgcgcacggcaccattccccgatcctgccgataaattcggttccgaacagtcgggaaacctgatcctgataggcaaacctcacatccttcgcatgatccgattccccgcaccaaagatacggaagcagttttccgatatcttccccgcattcctcctccagcagttccggcagtctgcggctccaggggaaaactgccggagcagttcccccatattccgtccagtctcccggatgcatgtgataagaggccgcattgccgaacctcggttcatcggaaaagaatccctgtatcactgtgccgaactcttccttgtaacgatgataatgctcttcatatatgatttgaataaagcggtccacgcagtcccggtcaatcggattcacatagtccttcgtccattcctccccgccgtttccggttaaaataaagagaaatattctccaggccccctccggaacatcccagtacagaatgccgtcttcttccaaagaagtgatatccaccagactgccgtcttccagatcctcgtaatttccttttctcctggccgccgtcacccggatgattttctcatcctgattcagccagtcacggatccggaaagaactgccttcaagagggcctatggcatcgatatgggcttccttcacatattttttcccggcttccggataaaggcttttcagctttcccgccccatatccgctggggaatgcgctgtcgtcaaaaatccataccttcattcccagccttttggcttcggcgattatgatgtccagatcccgccaccagccgtaactcagataatccggatgcggcctggattccacaataaagctgtcgattccgttttggaacatctgatgtatttcttccttcagtaccgcctccggttccccatgctgccagaaaagaggcctgatatagctcttattcatcttaatacccctgccttatttcatttcatcggggagcgtacatccgagactctctgcagtcgccgccagtttttctcttccgcccttatccagccattccttctggaaagcttcccattcgtcaaagcttctctggcctgttacgaatttgtatttctgagcgatatcgaattcatccaggtttggagcgatatcccccggaatgttaatcaaaagcgcatcgttattccaccgttcatatttggccattttagcaacaccctcgtttatcagggcaaaataatctttttcctcttcatttgtggaataatactgctgccatttcagtgtatatccgaaattctgccatgcagccagatccaggttatcggtgccgtatttcgtatagccgggatgtgtgggagatacatagcatatattggttccgtcttcgttatactgcctgtaatcatccttataatccgggaacacatccaacccgccgccctgcacggtctggaaatacgcttctcctccgtagcacatggcgtccatgatatgacagattctcatgagctttccgggatcgtcctttacacttgcagccggaatcgcaaacaataaaccgggattgccgcttgccgcatatttgccgctttcaatagggggcttatccaggaatgcccatgcatcaataatactgtaatctctgttgtgggcgttgacatattcctcatataatgcgttggaaggataatgaaccattcctatcttatcattcatggtataggatttggccgtttcccagtctatcgtataccagtcgggagccaggactcccagattatacagttcatttaaaaattccagatacgccttcattgtaccgtcaaacatcggggataccagcgttccgttttccgcatggtcggtgggattcccgaagaaattgacgaaattgctcatcatgccgaagctggtgcctcctccggcgcccgtcataaaccaggtatcctgaatcccgtttccgtccgggtcatcaaaagtacacgccttcgcatattcaatcagctcttcttttgtttcaggcatatccatgccgaatttgtcaagccagtcctgacggatggcataggcccagatatcactgtcctgaatggaatatttggtaaagaagggtatggtgccgtcgggcatcgtactgtagccaaggatggtctttgtgacaaacttacaggtctggggcagatacggatagatctccttcgcgtcaagcagcagcccctgttctcccagggtaaagccgaaattcttgccgcttgccgcattcggaaggaccggaagcgtcacaagatccggaacatcccctgaagaaaatcttgtagaaagaacggtttccatatcgctctgtgcacaggttgtcaatgtgatgtccacattatacttctcttccagccatgcttcaattgggtcctccgccggcggcgtttttccgtaatgataggtgaaaagctcaatttcataccgtttgctcatatcatcgtaagcataccagtcctcttcagccagggtgggattcgcgggcatggaatccggaaaatcgatgtcttcaaacgctgttacattgcctccgctctcccctgtttccgctgtgctttcctgttgtgcagcgctctgctgcggttcactttccgaggctgcattgccggccgatgcattctccgcttttccagaacagccggccagcatggatgctgccagcgcggcagccattaacacagctgtctgtcttttccacttctttttcatcttctcttctcctttttatttatgatttcatagtgcgcctacccctttaccgctccggtatacatgccatgtacgaaatacttctgcaggaacggataaatacagagaatcggcagcactgctatgactacgctggccatttttatggattccgacgtcatttttgcataggtattgacattgctcatcatatctccgcttgaactggcaatgagaaggttcctgattaccagctgaatcgggtataaggcttcgtttcttatgtagaccagcgcatcaaaccatgcgttccaatgggtaaccgccgcaaacagccccaaggcgcataaggtgggtttcagcagagggatcgctatatatacaagcttttggagctccgacgccccgtccagctccgccgaatccgtcacatccgacggtattccctccacaaaaagctttaccaccaggattccgtaggtattggcaaaggccggcactatatatacccagaaggaatccagcagcttcagccttgtcatcagcatataattggggataagaccgccgttcagtatcatcgtgatgataaagaaaatcatgcatgccgaacggtaaggcagatcctgcttcgccagtatataacccgccggaaccgccagcgccagcgcagccaccacgcccagcagtgtccttgccaccgtcacgcccatgctgaggaaaaatttcttattcagcacatatttataggccgcaagaatgggttcccttggaataattacaaaataatttctctgtatcatttcaccttccgatgtgaaagacatccccagtacatacagaaacggcacgatacagatgattaaaaacagaatcagaaacagggatatcacggcctgataaatcagttcctctttcgaaagcttaatcttattgggattacgtttcatgtcctatgcctcctaaaacattcctctgccagttgtctttttcgaagtataatttgccaccagaatcaggaacaggcttatcaccgccttcagcatactcacggccgcgccgaggccatactgcattttgccaaggccgacacggtatacccaggtatcaataatgtcacccacatcataaacagccgaattatagaacaacagtatctgctcaaaatcattgttcagtatattgcccatcgccatgatcagggaaaatgtgaccaccggcagcatagccggaagcgtgaccgccctaattctcgcaagagggcctgccccgtcgatttttgccgcttcatacagctccggattcacgcctgtgagcgccgcaaaatacaaaatggttgcccagcccgtctccttccaaatctgcgatcccaccaacagaggaacgaaggctttggtggaagtcatgaactctgtcctgcttcctcctgccgcaaaaaggatattattgataaatccatttccggaaaagaaagcgtatacaatcccgtagatgacgacccaggaaaagaaatgaggaatataaactatcgtctggctcaattttttgaaccggctgttcctcagatcaaatatggcaatcgtcagcagtataggagggaaaaaggtaaacagtaaccgggaacagctgataaccagggtattgcgtatcagccgaagcatatccggatccttgaaaattgcggcatagttgcttatccccacccatttcgcccccattatcgtgccgcccaccttaaaatctttgaaggaaatcaggaagccccacaaaatggggatatactgaaaaagcagataatacatcacgataaaggcgagggccagataaaggaacctgtattttttcagttttttctgtttctgcaaacgtgcttccttcatgaaatccgtcttagacgccattgaccttacccgcatcacttttctccccatttcctgtttattttatctgatttcctgttgttttgacgattatacaaattgatattacagacgagtaaaaattgatatttaaaagatattttcaggtttttctatttttcagtactgttgttttgtgcatgtttatataaaattcatatctttgtctgaattatatatgagatattaacatttcttatttgattattctacgacaaaagcccagcagtttaacgtcaaaacttcacattccaaaaacatgaaaacacaacaaaaaaccgtgtcagaattcggtacagcccgaatcatacacacggttttctatttgctttatgaggttaaaaaacttgtaataccttaccctgtctttcctttatttctgtagtccctgggggagcatccgaacctttccttgaattttttataaaaataggttccgtttccgcagcccgacatggcgattatcttatcacatgcaaggtcggtattcaggatcatgcctgcggcaaactgcagccgctgttccatcaccagctctttaaaggaatacccggtcatacgcttaagaagtgtcgtcatataattggcattcagcccgaatatttcagccgtatcctttaacgtgcattccctgaagttttcttcaatgtaatgcatgatcgccaccacacaggttttcctgtgaccggcaagctcctttacgtttccgttttcataaacattcaccagctccgagaaaagcaggacgatgagattattgataatttccttctccatactggtgggcgaaaggaattcacagatcagctccttcataaaaagctggatcctccgatccttttccgaatcgaaaacaatatagctgtcatgataagtctgttccgacatgacattcatcaggaactctgtaatgatacccaaatcagccagtctggaataaaaggaatggtcgaagaattctttttccatcagcatgttaatcaagatatcattttccccggtatatccgattgcatggggaattcctgagtcgagtattataatctgcccctgcttcagcaggatttccgtctctcccaccgtctgcgtgcagcttcccgaatacatatatccgagctccacccaatcatggacatggggctccacctcagcaaaacgggcattcttattcatgaacagattgcatcttttcttatccacatagacggtatgccctctggccgtccgcaggcgtccgggcgcatcaaatgtttccgaacaggaataccccataacgtacacctggattgtttttcccttctgcttataggtaatctgttcaaaacctgaataatcgggacggcagattttatccttcagcttttgttcatacggctccagacctctgagtctgccgtccatttcttcatatgtcatttccccagcactcctcccgacagtttcgttcttctaaaagcttatcctgccggatatatcaagtcaagagtacatttatcatatgaggccgtttgaattttgctgcatggagttcatttttttgcttaagcccgtcagtccagggcatggtcaatagctatatgtccgccgctccatacctttctgccgctccagtcttcatcctcccctgtccagaaggaatcctccgccggaagccccagcggcaggaaaacggcgctgcacaaataaaggcttcccacattgatatacccttccgcaagctccggctggaagccgtataccccgggacgcagccaccccttctcatcaaacatatccccgttttccaggcatctgcgcagcacggcggtcagagcacaccgcaccccggctggcgcgagccctttctccagcctgtgctgcagggcggcctgggccagcatctgaaatgcgccgaaccgataacagatcgaacggccaatcacgggataacttccgtccggagcaatcatacgttccagaacggaggcataccgggaagctctggccattactttttccttcaatatcctgtattcttccgccgaatccccgaacagctccagaagatccacatacatcggctggatgacaaagctgttatagtaatcccagtggaacatctctccgtccccgtaaacgccgtcacccttgtaccagccctcaaagctgcgcagcgcataggcaatgcgcattttatcataatcctcttccccaagcagatacaggccggcctccaccatggcggaaaagaacagccagttggtgcttccggccatgattgtacgggaagagcgcagcgcctctgccaggttatgccgcacccgttccgtaagctttcccgccagctgtttcggcgcacgcacaagggcatggcagaggaacgccgtatccacaaggggctggccccctgtggtgaaattcataaaatccacggattccggattcgtggcagcgtccagacagcgcagggccttcttccgccagacggcctgcagcttctcttcctcttcctcaagcccttccgcttccagccagggcgcaagccccagcatgcttcttccgaaggcctccagcggtgcatattccgacctttcctcatgaaaatccaatggcatggttttatgtaattcctctttctccaatgcgtcaaaaaccggtgaaacaatgcgcagcatagactccagccattcttttcttctctgattctccattttttccattcctccctgccacagcttccatgaattccaggccgtgtatccggatattttctgcctatattcctgtttgttatattttaccagataaaacagtctttatccagcatgcgcaggatggcttctataaagaaataatccccgtaaataattgcttcctgtccggcttccccatgatatgccacttttcccatttccagaatggcatccacattttcatcccagttggcgaaatgctcttccatggcccgtaaaatacggtatgcgctgtcctcataaagcttcttttcattttccggcacaaacccggctatctccagaaggccgcatgccgcacaggctcccgctgtggaatcatagaaaaccggctcctcgggagcacggaaatcacagagcggcagatagtccgtcatggccgcattggcgataaaataatgggctatccttttggctgcatccagatacttcacttctttggtatgatggtagctcagggcaaatccatataatgcccaggcctgtcctctgctccaggagctgttttcctcatagccctgcccgccgggcgcttccagcagatctcctgttaaaggatccatgattccaatatggttgcaggagccatcgggcctgacaagcttctccatcgccgtgtccgcatgcatcagcgctatggatttaaaacggggatccttgttctcctcgctcatccagtacagaaggggaatgttcatcatacagtcgatgatcatccagccgatattgctgtccccgttccaggcgcggatgaattttccaaggggattaaacctgcctgccagtatattggcggcattttcccctctttcacgggatttgggattcccggtcagccggtaatccgccaccgccgtatgcagccacataaagcccacatcatggttcagctttccgatactcgtaaaggcggcgtccattttgttctccacaccttcagccgccagacggtatttttcttctcccgtggcatgatacatctgccaaaggatcccgccccagaatccattggtccaccagcatacatccgtttcggccaaatcgccctcgtagcggccgttttcgggaatatagggaatcctgtcccccaccctggtacattccgcactcatcttggtacagattttaccatatacctcctcaagccatttctttttttcctgctgcagttcttctcttttttccattgaaaattcccctttctttcatttaacctctatacaaataaatttttgactgtaaaataaacttagcgggattcctgcataaatgcattttccctatactatctgaaaggacaggctgccatgattacagtaggccactgcggctatgattccaaacaccggacgcatctggaaatgaggcgcccctgcggcactccggattatacgcttcttcttgtcaaaacgaatgcgttcttctccataaagggggaacgtatgctcactcttccgggaaccgtcatcctttatgataaaaatgtacctgtccattacgggagtaccgggctccttttcaataatgactggatccacttcctgcctgatgaaacggaccttccttttctgctggggctggaaatccctttcagcacgcccctctcccttccctacatggcgcagctctccgagtacgcccggatgatcgtcatagagaagcatacggaccacccttaccgggaacagatcatcaattcgctcatgcatgcccttctttattctcttgcctcccagcttaaggatcctgaggataaggtcatgaccaataagtattatcctgttatgaatgatctgcgcatgtccatattaaatacccctcataaaaaatggacggtggaagccatggcggaatacgtccacttaagcccctcctatatgcagcatctgtaccgggaattattcggcatttcctgtattcaggaggtcatacaggcccgcctgggcacagcacgtttttatctgcgcacaacagatatttccgtgcagtccatcgccgcactgtgcgggtacgataatgaactccattttatgcgtcagtttaaaaaatttacggatatgacgcccagccaataccgcagttcgctgcctccgacgacataaaaaagcctccggacagcatttctgccgccgcgaaggctgtgtatttccattgccggcagaaggaagaaatggtatttagtaacccttttctttatagcctatttttcttccgtccgcaatgaactattccctgttaaactgacatatcctgcttttttgctctgattgcctttgtccggaatgcgcctgccgcttccggccccgactttactgaacggagcagcttacggcggtatagccggcatcctccaccgctttcataagcgtttcatcggacacctcctgtgagagcttaaccaccgcttttttagcctccaaatcaaccgctgcttcactgactccttccactgcggccagagccttctgtacatgcatctggcagtgagcacacatcattccttctacctcaattactttttccatttctttttctccttttccggacggcattttttcgccgttcctttcttcttttttcacttcccaattcgcttctttgtttgattcatggctatcatctccggcacttatttccgcagttcttaactctgccgtacctgaatctgccgttccatttttcttctgttcttccgccgtatcggaaggaagcgtccttcccttgaaaaaccgcagcctgagcgcattggtgaccacacagacggaactcaggctcatggccgccgcgccaatcatggggctgagccggatattgaacatcggataaagcaggcctgccgccacgggaatgccgcagacattgtagaaaaatgcccagaataaattcatcctgatattgcggataaccgatttgctcaaatcaattgccgtcaccacatcctccagggaatccttcatgagtaccacatccgccgaatcgatggcaatatccgttccggcaccgatggcaatccccacatccgcacgggtgagcgcaggagcatcattgatgccgtctcccaccatggcaaccttgtggcctttttcctgcagttcgcggatacaggattccttctgtgtgggcattacctcagaaatagcttcttcaatatccaggttcttccgtatggcctccgctgtaatccggttatcaccggtgagcataaccaccttcagaccagcttccttaaactgccttaatgccgccttactggtttcccttaccgtatccgccacggcaataatcccttccagttcctcttcccgggcaaacagcagaggagtctttccttccgacgccagactgtccacccgttcctgcacctgcttttgcagctccggctgtttcagaaggccgttttcctgcaggaaggccatgttgcctgccagataccgcttaccctttacaatggcgctcacgccccggcccgcaagagaatcaaaggcctccgcctgcggcaggataagaccttcctgcccggctttttccactacggcaacggcaagaggatgctcactgccggcttccacggccgccgcttccgccaggaattcttcccgggtgttctttttattccacagaatcacatccgttaccgaaggatgccctaccgtgatcgttcctgtcttatccagcactaccgtatcaatggaatgcagggtttccaggctcaccgccgattttatgagaatgccgtattccgccgcctttcccgttcccaccataattgctaccggtgtggcaaggcccagggcacagggacaggatattaccaaaaccgcaatggcattggaaagggcgaactcaaaggactggcccgctatcagccaaactatggctgtcagtatggcaatgatgataaccgccgggacaaaaaccccgctcaccctgtcggcaagacgtgcgataggagccttggtatttcccgcctcatccaccagacgaatgatctgagccagtgtggtgtcatcccctactctggacgcacggaaacggaaactgccgtttttatttatcgttgccgaaataacctcatcccccgcttttttctccacagggacactctctccggtaatggccgcctgatccacatagccgtggccttccgtcaccacaccgtccacgggaatgcttccgcccggcttgattaccacgatatcgcctgccgtcacattttctgcgggaatcacctgttcgatgccgtcccgcaggacaaccgccgtcttcggggccagatccaccagcttacggagcgcgtcggaggtctttgccttggaccgcgcttccagatactttcctacggtgatcagtgtcagaatcatggcacaggactcaaaatacagttcatggccgtattgatgcacaaggtccatgtccccgtggccgaaaccataggccatccgatacatggaaaacacgccatatacaaaagccgccgcagatcctatcgccaccagagagtccatgttgggcgcttttttcaccagtgccttaaaaccggactggtaaaaatggcggttgatgatcattaccggaacagtgagcagcagctgggtcagagcggatatcagggaattttccatacctaccagaaatcccgggacaggcagcgacatcatcggccccatcgccacatacatcagaggaatcagtatggctaccgaggttatcagacgccttttcatttccttctggttctcttccgtcatttctctccggtcctgccattctttcccgaatccgctgtccttttgggattccgttccggtgccggacgccccgtagccaatttccgtaaccgcatggataatggcctgttcatctgtcttttcttcatcataagccaccgtcatctggttcgccagcaggctgacgtttacctcctccaccccatccagctttcccacattccgggtgatgttcgcctgacaggctgcacaggtcatccctgttatatgaaacttttcgtttttcaatgatttcacctctttttcaaagtaatacgtgtttactttaattttttaattaaatccaccgcttcgtctacaatctgaagatttccgtttttgatttcctccaccacgcaggtttccatatgatcctggagtatgatgtagccaaagctctgcagcgcgctttccacggcagcgatctgggtgaggatatctccgcagtaacgattgtcgtccagcatttttttaatgccgttcaactgaccaatcatccggttcagacggttctgcagctgtctgttggacgattcgctccggggagtgttcttatgatgggaacagcagtcctggcaggccgtacataagttatctttttcctttgatttatccggcataatatattacctccatgaatgtaacggattattataagaacagaattaagctgttgcctgatgatgtcagtataccccggcagggtatatcctatgcatctaaaatatacccatacagggtatttgtcaagcaggaattttcatatgcaggattttagaattttcatatgcaggattttagccggcccaatccggcaaaaatgttaagactttgcaaatttttaaatttcttattgtaaaatctcttattttcccttaaaataaatgacaatcattaacaaacaaggagatataccgccacatgagcacaccgaataccacggtgcccgattccgatgattccgataagtcttcaaataataatatcttcaggcataacctgtattgattccaaatacaaggtatgctttttttgtagttttcttttaccgggaaccttcctgaaccgatgaggataaattaagataagaaaggatacggcaataacattctgttttattgtctgattacaacatggaaaaaaagaaagcctttatcattaattttttgtattttgcatttctgctctgcgccgtttttctgctccttaagtacgggctgcctatgctgtctccctttgtgatcgcatttgtcatagcctatctgctgaaaagacctgttattttcctgtcacgcaagctccatctgccgaggaagcctgcggcagtcctccttgtgctggtcttttacagcactatcgggctgctgatttccctgctgggcatccgcgctttttccaccacaagggatctggttatgaatctgccgcagatttacgccgctcatgtggaacctgttttgactgatatcttcaggaacgttgaacagggcctgaaaaaaatggatccctcgctggtatccactctggaggatcttttcaaccagtttatccagtctatcggacagatggtttccagcctttccatgagcgctatgggcaccatctcaggtgtcgcttcttccctgcccggactgtttatcaagctgctgctcatgattatatctacttttttcatagcggcggactatgaactgctcaccggctttttcttaaaacagctggacggcaaatccaaacagatttttcttcaggtcaaaaaatacgtggttggcactctctttgtatgcatccgttcctatgccctgatcatgacgattacctttatcgagctgtccatcgggctgagcattataggtgtcaaaaactccatattaatcgcttttttgatatcggtattcgatgttcttccggtactgggcaccggcggcatcatgattccctggacggtaatcgccgcattgacgggggattattctctttccataggattattgatcgtttatctgatcataaccgttatcaggaacatcattgaacctaaaattgtgggaagccagattggcctgcatcctgtggtaactcttgccagcatgtttgtcggcgtccagcttttaggcgtcgtggggctattcggcttccctatcagcctgtcactgctccggcatctgaacgataacggaacgatacatttatttaagtaaagagcatttaaaagccggcagacaggaaattcatcctgctgccggcttaattttactctatgactaatcattatccggaagaagcttgattctgacaagaatctttctcacaaactgtccttcttccagttccaaatcaccttcatgggtctgagagggaagttcgcactcctcttcttccatttccgcgcaaatccagttatatgccgcttccgcagcattatcaatggcatcctccaaatccggtccatctgcttcacagcattccagatcaggaaataccacatgatagcctgagccttcctttttgggggtaaaaaccgccgggtaggtaaatgtcattgtgtgcctcctgattttcagccgggtctttcctcagataaattccggcttttactttctgtattattataggggcaatagggcgggttgtcaaacggaaagattcgggaggttgtgagggtaactgtacccgtgagccctgtgctgtcttgcctgtcccccgggcgcctttcccaggcagcctgccgctcaagcaaggttcctgtgcgggcacgctttcgctcggataaatacgcagcggtactaaggttgcacaggacgcaacctaaggaccggcgtatttatacggcccttacaggaatccttgcttgagcggcaggctgcctgggaaaggcgcccgggggacaggcaagacagcacagggctcacgggtacagttacctgcaaagatattgggatatagctaattagaaaagcggagttaggcttgacatctttatggtaatattctaagattacaccagaaaaaaataagtatatatttgttcatttttagagtggaggagggcttatgagtgatatattaaaggctccggtttatgaagggaggcctaagttgggggaggggcggctggagaaggagattaggacgtatgatcttttggatcggctggcaatttcttatctgcggctggatcatgaggctatgcctactattgaggcttgcagggatgtggataaacgtcttcagatccatatttgtaaaaatctttttttgtgtaattcggggaaaacggatttttatctgttgttaatgccgggagaaaagaagtttcataccagggaggtgtcttctcagcttggtgtttcccggctttcttttgctcctgaagaaaagcttcaggagcttttggatcttacgccgggttctgtgactgtgcttgggctgatgaatgattctgcgcagcgggagctgctgcaggagccttatatggggtgtcatccttgtattaatacttccagcatacgtctttccacaagggatgttctggaaaaatttctgccggctgttaaccatatgcctgtttttctggatctgagtgcttaatcgcggctgaaatagtaattcaggacggattttgatctgtcgactacgtaaccgcttcctcctcttccttttacgtcttctgtcatcgtgagcagaaggatgggggattttgtatctttttgggtggtaaatatgcagaaccagccgagctcggtaccgcttgtgtcatctttggagagcttgatttccgcggttccggtcttgcctgccagtgaaatgtcttcacgtcttgcgccgtagcctgtcccgtggggggagctgataacctgcatcaatcctttttctatcagctgcgctgcttccggtgtgtatgcctgttccagccatattttcggttccgggtttcctttatagagcaggtaggggctgatgacatttccgttgttggcaaagcctgtataaagcgctgccaggtgcaggggatttaccagaacttctccctgtccgtagccgctgtccgcgagctgaatttccgaatcaatcccttcactgttggagtattgggactgggccatggatatttcaaagggaatcggttccccgaagcccagcttatccagtccgtctgtcaatttgtcactgccgatacggagggcggctttggcgaaataaatattgtcggaataaatcagggcattttccagaataacgggatcgtatgcgtgaagggtggtgacgtaatactttccccagctggcatccttctgccactgaagtccctcgtttccgtaatccatgtccggatcgatcgctcctgtttcaaggcctatcgctgctattacaggcttaaaggaggaaccgggacacagcttctgccggaatctgttataaagaggcattctttcgtcttcattcaggctgtcccaaagtgtctgggacattccatatataaagtcgcggctgtcgaatgagggtgtgctcaccagggccagtacttcccccgtgaagggatccatggctacggagcagcttttatcctccgcataagtgtcatatagttctttctggagccccgcgtcgatagtgagctgtatggtctggccgtcccttttcgggatttgtgccagaacgcttttcttttgtcccgcatcgttcagaatggcaatctcacatccatcctgccctttcagttctttttcatagagcagctccatgccgcttcttccgatgacactgttggcgcggtatccctctcccggatgtttttccaaatcttccgctgttacctgctggatataaccggtcagatgggaagcggctttgcctaaaggatagtctctgatttccacatcggttatcaggactcccggaatggctaataaagcttcctgaagttcttttttcttctgtacttcttctcccggattatccgacataagctcctgatcggtcagcttctgtatcgtttttatggggacaaaggagtcatcctttacccacttggcggacagcttcttttcaatgctttccggagatacctccaaaagctctgccagacgcactacagagggtgacgaaattttttccggctctgtttccgtatttgtttcggtacttgcttcggtaccttcggagctggtttcttcatttacgtctgaagatttatttgctgctgtttcttcatttaccggtgtctcttcgtttcctaccgggtcttcatccgtaactgtttcttcaccgaatatatcgtcggattcctcattcttttccatcttcccgggtacaagcccgacggaagagccaacgccttttcctgccagcatcctgccgctgcgatccacgatttctccccgcgccgcgtcatcccgtgtaaccttgactttatccgttgcagtgagttcaggaaaaatcaggctgtcatcccagacaagcagataaggatagccttcctcccccttttccagctggtttttaaggaacacaaccttattggaaaaagagatttctccggcagacgtattcatactggtatcgtagaaaacggttgccgcctggctgccgctctcctggacctgggtaacctccacacggatttccgccgcgtctattccctgatagatatttcggttccgctctgcaaatgcctcgcgggagatggattcctggctctgaggctccagcatgtcatacatttcttcatacttatcctgctcaatctccgccatataatagcaaagcagctcctccggggtttttggctcttccgtcttctcccctgcagccggcagaatatttttcagaagcatgaaaccgccgaacaccagcccggctatcaccagtactgctgttcctgaaataagaagcttccttgttctgattctctgtctcctgcttcttctgcgtcttctttttgtcctcataacgaaaaacctcccttacatgcaacaaaggaagacagcagtgactctgtcttcctggcctttttccatcctacaaccgtaataattgcatgtcaacttttttctacagctggtaaagcagggcgttgcatatggcggcggccacgttgcttcctcctttgcggccccttgccactatcacaggcacgcctgccgtgagaatcagttctttggcctccaccacgttcacaaatcccacaggaaccccgataatgaggcggggatggattcttccttcctttatcagttcatacaggcggataagggctgtgggtgcgttcccgatggcaaaaataaaatcctcctgcatttctgccgctttttccatgctcacggccgctcttgttatccccaggcgggatgctttctccgccacatcctcatccgccataaagcaatggacgcttccgcccagctgtcccagctttttcttgttgattcccgcttttcccatattggtatccgttacgatggaaacaccgctgcgaagagcattaagcccttcctccaccgctccttccgagaaaaaaagggtatccgcatagctgaaatccgcggtggtatggatcactctttttatgataggcttctgtaccggatccaactcccgccccagttcttcctctataatggcaaagctccttttctcgatttctccgggagcatattcttccagtttcatatgtatcgtcctttctgttttcctgctgcctttcaggtattccgttttaatccagtcctattatcctgtacaccgcctccatatcaagatgcatccgtatcacatccgccagccggtcatactgctcctgtttataagcctgtaaatccctgtatactccgggctgtattcctttttcccggtacaaaggttccagcatccccttcagcagttccggggaatccaatattccgtggatataggttccgcaaacattcccctttacacatccgtctgcatactgctgtccggtcacgcagtccgttacgtctgcaaaacagctgcagccttcgcctgccatggattcacccatatggatttcatagccttccgccctgatcccgctcatctgttcaaagacaccggaaagcttccctacgtttccttccactctggtacggtgcttcttccccctgaaccgggtcaccaccggcagcaggcccatgcctgcaaggcttcctccatgctccacgccttccggatcctccagaaggcttcccagcatctggtagcctccgcagattcccataatccggcagccttctccggcaagcctctggattcccgcttccaggccattctcccgcagccagagcagatccgccatcgtatttttgcttccggggagcaaaagcaaatccggctttcccagctcccccgccgactttacataccggacggaaactccttcacagccttccagcatgccgaaatccgtgaaattagagatatggggaacacggatgaccgctgcatcaatccctcctgccgccgtgcgctgttccagcttctccgacaggctgtcctcttcatcaatatccagtctgacataagggatgactcccgtaaccggaataccgcacttgtcatacagctgcttcagtcccggctccaggatggatttatccccgcggaatttattgatcacaagcccttttaccctggcccgttcttcctcctccagaagccagatggttcccagcagctgggcaaacacaccgcccctgtctatatctcccaccaaaagtaccggcgcgtccacaagagccgcaaggcccatgtttacgatatcgttttccttcagattgatttccgcagggcttcccgccccctcgatgactatgatgtcataccggctgtcaagctccccataagccttcataatagaagggatcaggctttttttcatccggaaataatcccgcgcttcccggtttccgaacacttcgccgtttacaattacctgggagcccatgtcgctgtttggcttcagcagaatgggattcatccagacattcggttcaatccccgccgcctccgcctgcattacctgtgcccgtcccatctccaggccttccctggtaatataggaattcaacgccatattctgggatttaaacggggccacacgatagccgtcctgcttaagcacccgcaggatccccgccgtcagtatgcttttccccgcattggacatcgtcccctgaatcatcagattttttgccatgctgcctcctcctcgtaaatagcctgcagaagcgcttcgttttcccttctgctgcggaccgcaattctgtaatcccccgcccgcagctgcctgtaattctcacagctgcgcacagcgattcccctgtctgcaagaagcctgtccagaccgggcagagcctccagaaaaatataattagccatagacggatatatccgccggatcaggccgggcgcctttttaagccctgccacaaggaattcccgttcctcagcgacatataccaccgttttttccgcatactctttttccttcagcgccgccagtcccgccgcctgcgccggaaccgaaacattccatgccggaagctggagcatgagacggcggatcacctcccggctttcgcataccccataccccagccgcagccccggcatggcatacagcttggtaaacgcattcagcaccagaagattctcatattccttataataccttctcatgctccgccgtccatattctccggaaaaagcgaggaaggcctcatccacagccagccagatccccctgcgcgccgtcagcctcaaaatctgctccatcagagaaggttccacacagcttcctgtgggattattgggattacagagaaacagcagacttcccgtttcctgtttttccagaaaatccaggaaatcctcatccacagcgaatccattttcccgcttcagaggataatacctgaccggacatcccacagacagaaacgccctttcatattcagaaaaagtgggggcaggaagcaggcctgccgccggcctcaaagcccgtaccgccgcataaatcaattcggaggctccgtttgtacacaccacacctccggcgtccgtcccccattctcgggcaatcgcctcccgaagggacaggctttccgcttccggatacctcaccgcctggcacagactttcccggagcgcctccgataccccctccggcagccccagcggatttatattcgcggaaaaatcatatctgatatttttcccgtttctgcctccgtgttcaaaaaaatccatttttcctctcccgtcctaccttatccgtttttttagttaaaataccaatggaagcacacaccgtatcagcagtcccgccgcacataaaagagatgcggaaacatataaaagccggtttgccctggcaatatcctccggttccgccggccgttttccatccccgataaacggctttttcaccactttgccaaaataaacggcatccccggcaagcgcgatacccaaagcccctgcgcacaccgattccgtctgcgccgagttggggctggcgtgcttaaaccgatccctgcgccagatacggaaagcgccttttccatccattccgcacagccaggccgcagctatcataagaagggccgccagacgggacggaataaaattcaccacatcatccagccttgcggcaggcctcccgaaatacaaatacttttcatttttatatcccagcatggaatccatggtattcacagccttataggcaaatcccgccgcagggccgcccagaagcatgaagaacagaggggcaatgcttccgtccgaagtattttccgccacagtctccaccgccgctttggttatcccctccgccgacagcaccgccgtatcccttcccacgatcatggaaaccgcctccctcgctttttccacatctccatcccgaagagcccggcataccttcatgctttccaccttcagacatttcgtcgccataatctgataacacataaaagactccagcacaagccccgccgccggatgcagccaataagccagccataacagcaaaacaggaatcaggatcgaaacagccacaatcatacacaccagcaatgcccccgccctcatctgggctgccggcgtcccgtcaggacggcgcagcttcttttccagcgcctgtatccccttacccatggccctgacaggatgaggcatccagtaaggatccccaaaaagtaaatctaagataaatcctgcgaaaatactaatggttgtatacatgaaagttcaatctctccttttccaatctcctccggactgcccccggccacacagcgatacccctgtccgctgccgcactgataagaataataatcgccgccctccgtgccaaaccgttccaacagcgccattatcgtccctccatgaacaacacaggccgccctcagttccctacttcccgtccctttcttctcttccgccctttcccattccgcgcagatccccgccatccgcacaagccccgtgcagcatctgtcctgaaaagccccccggctttccccttccggaaaaggcagcgtccccccgctgtcaatccatgcctgataatggacattccccgtcaattcccgataatttttcccctcaaacaacccgaaatcacactccctgaactcctctatcaccaccggctcctgccccggatacagcacctccgccgtttccagacaccgcctcataggactgacaaacaccaaatccgcctccggatactcccccgcagccttccgcctctccagcatcctacgcccctcatcacacaaaccctcatccgtcttcccaatataccgcttctcccggttcccctccgtcatcccatgccgaattaaaaacaaccgccagctcataaatctcctcctcacagccttaacttctctcgctcagccctctgccttcccatcccccttcaacacctgaggaatcccacagaccagccgctccacccgttccgcccggctgaccaccatccccataatccgtcccaccagttccctgtactccctctcctccttctccatcggaacaatcccgcacccaatctcatcacacaaaataatcacctgcggattcccctccaaaatccgtcccaccgcctcaaaagccttttcactattccccccgaaccccttcacaaacaaatgaaaatgcgcaataatttccgcccccagacaatcctccaccccggcactctccccaaaaacaatcctccccttctccggatacctccccttcacataatcaagcttcccctgcgccctgcctcccacataaacctccataacaaccttcctttctcttatatctctttatctcttttctttttccctttcattacctacccccagttcgttttcccttcgcccgggcgtcggcaagccccggcgaagggaaaacgaacgcctcacaacaaagcaatgacggccggtaccattgcactcacccactcggcacagagcagaaaccatcctgccagatcccctgtaataccaccgaattccttcttcgaatcatacccgtaccacccgaacaccgcaagattcccagccacagtcaggcttcctgccaatggcgaaaccagaaccattcccaaaacacatactcccagaagaagaaacaacacaagccttacagtcctcttgtgtgccgtggaagaaaaagcgtataaaagcccttccttttttgcccccgggaaatacacaatactcagcccgctcaaaatacgggaaagcagaaaacccaggcagaaacacaaaaccgcccgctcacttcgcagttcagaaatccagcccagataggtcagataataacccagcagacagatgacggaaaaagcgccgatatgggaatccttcagtatccgcagcttttcctccctgggaagataggaatgcatggcatccatggtatccataaacccgtccacatggattccccctgtcagaaacagcggaatggccgccatccccgccgaaaacaaaagtgtccccgcctgcagatgcccgcagatcagaaaccacacatagcacagtccccctgtcaccaggccgaccagcgggaaaaagcatatggcatattttctgttttcctccgtccattccaccctcggcatcggtattttggaatacatggaaaaggcaatgaccaaagaagaaactactgttttcataagctttcctttccaaccgccggtttttccggcttttttttaaggcagacaggaatggtatataccacctcgtaggcttcttccgccttttggcacagactgcagttaacctgctggagcagacggatatagctttccgtactctcgtcataggaaatgccgtctgaggccacctcccctgtaacgattaccagattccggcacttggcatacagacgctccacatcctccagtatccggctgccgatcacggtttccgtcttacccggctcgggttcccctcctcccgccgcgtcttccggcccttccccggaaaacatttcattagccgcaagattggtcatgcattccagaaggactgtcgcacctgcctccggttccgccaaatccacccgggtcgtgcgttctattgtggcaaagcctttccctttccgcagctgccggtgacgttccaccttccgtctgccctcttccccatacacctgcatggtagccagatagtacaaggggccgccttttgccagccttaccgcctgtttctcagcgaattctgattttccgctgccgcttcctcctgtgatcaccatcagcattccgacacctctttcgcgctgtaatcataaccgtacagacaagtctgaacggttacctgtaatcctcatatgcatccatttccaaatccccgaaggtggcgttttcccggtaaacctggcacgccatgtccagaagcgggaaaagagctacggcaccggtcccttccccaagcgccaggcgggcatgaatcacggggcaaaacttaagttcctcataaatggccgccatggccggttcctttcccagatgggaaggcaggaggaaatcccggactcccggaagaagtctgcatgccgtcagagctgccacagcagtaatcagcccgtccagaacaatgggtacccggtatatggccccgccgatacatgcgcctgtaagggcacacaaatccaggccccctaccgtacgcagcgtacgcagcgtttcctgcatcatgagctgcgtatccttttccccgtctccggaaagcggcccgtggattcccagcttccaggctgccgctgcctgattaataaccgcgatcttcctccgaacgccttctttatccagccctgcgcccggccccgtcacctcttcggcggggagtcccagcaatacggaagccacggcgctgctggttgttgtatttccgatccccatttcgcccagggccaggatatgataaccgccgtcggaaagcatttccgtcatttccacgccggcccgtattgccgcaagcatatcctcatcctccatggcgggttccttcagaaaattgcgggtgccgttcctggttttttccaccagcagccctttcagcttcagatcgtccttcatccccacatccaccgggaatacatccgctccggcgcaggaagccatccggttgacacttgccaggcccttagcgatatttcccgtcaccaccgtagtgacctcatggccgctttgggatactccctcttcgatgatcccattgtccgcacacatgaccaccaccgcctttttatccagagtaatgtcctccgtcccctgaatggccgcgatctgtaccagggcatcctccagcaggcccagcccgtgcagaggcttcgcgatggaattccagtgcctttcaccggcttttcccgcccgcctgtcaggctcctggatcctttccccgcactgtctcagatattgtaatgttttttcttcgttttccatacttttctgccgcctccacaaatgcgtatgccgcttttttattcccgtaaaaataaagatggggaaaacctgcatacattgttttatccgccacacctgccatccatccggcccggcctccgcccttttgggccgcaaaggcatctcccgggcaggtgctgtcataatagtgaaattcatgagcttttaaggtttcaccggtcctgcagagcaggttatccttttccgctttcattgttatgtacccgaaacgggaaagcttcggcgtacggtaacagtctcccggaagcacgccggccatttcatgatattctcccttttcatcctgaagcctccggtgcagatacataaatcccccgcattccgcgattaccggcattccgttttccaccgccttttttactgaccggcgcatggaaccatttttttccagtctgtccgcatacagctccggatatcctccgttcaatatcagggcatccgccccttccggaagtccgctgtcatgaagagggctgaaacaggcgatttcacagccgagatgtctcaggaattccatattgtcctggtacaaaaagcagaaagcttcatcctttgccactgcaatttttatcccattaaatactttctcttctcctgctgcaaatccggtaagatcaggcgcgctttccgccagttcccatatgccatcccagtccagggaatctttcaggctgtcataaaggagggcgagcttatcccggaacccttcgatttctcccggagtcaccagtcccagcttccggctttcaaacgccgcttccggaaggcgcggcacataaccgagcacacaaacccccagcttctgtgcttccctgcggatatccggatagagcacaggggaaagctggttaaagatcactcctttgatcccgggccagctctggctttccaggaatccccggagcacggccagcacggaacggctcatccctcttgcatttacggtgagtatgaccggcgttttcgtcagggccgcgatttcactcgcactgccgttttcggtaaaccccatgccgtcataatatcccattaccccttcaataacatggatgtccgcctgccgtccggcaagcagagcccggagcgtctggtcatcggtaaaaaaactgtccagattaccggtttctatcccaagcacccggctgtggaacatagaatcaatataatccggcccgcatttataggcggcaggactgtatccctgtctgacaaggccgtataaaatgccgcaggtcagggttgtcttcccgcagccgctcccggtgcctgctatcaggatcctgggggcgccaggcctcctttttttcttttcttccgctgtttcactcataccgtcatatccccccacagaaggaaaatcggattctgcgcctgaagcatatgcagcccgcccaccggacgcagcctggtgactccaatctgacaggcatccatattccgcatgttctttttttccatacactggatagcctgcgatacggtttccatggtgaccgcgctgatgcagatgcggacggatctgttttttccggggatagcatccaggattgggtcaagcctgcccttcgttcctccgataaaaacagcatcaggcgcaggcagccccgtcagagcctccggggccatcccttccaccgccgtcagattatggcatccgaacttttctccgttctgccggatcaggctgatgccctccggatcacattccactgcataaacctgccctcttcccgccgcaagcgccagttccacagacacggatccggttcccgcgccgatatcatataccacatcatcttcccgtaccgcaagtttgctcatgataacggccctcacctcgctcttggtcataggtacctgtccgcgtacaaagcattcctccggtattcctgtcataagaaagcgttccggcttttcattcaggagaaagagaaccgtcaggctatcctcctgtccggaagggataccggccgcctgccagtccttcgccggacattttacgatatgttcgtccggataggaaaggcggctgcccgcgcagaccatgacgtcacccagccctccctccgtcagttccctgcagatctcagaggtctgccctccggtgagcagaaaggttttccggctgcgtttcaccgcggacagcaggttatccttcctgccgtgaaggcttatgaccgccgcgtcgtcccagggaatctgaagcctggaggcgaaataggaaagggaagaaattcccggctccacatggacggatacctcgcgccattcccgcacttcttcccggtaattttccagagcctcaagcagcttttttgtcccgctgtaaaatccgctgtccccggacatgagcaccgccgcgtcttttttatgactgtttcttaaggcccggcagattttttcaggctcgtaggctctgatgacatcccgttcctccgtgctgccttcctgcaggccgcaggcttccagcatccggcctgcccctgtcaccagaccggcgccaaagagcagctcttttcccgtgccggtcatatttccgggattccccataccgattccaataatagttatcctttgtttatccataactgttttcatcctttgcaagcaggatttttttcacctgttccacggaatatccttcttcctgtccgggccgttttatgattaccaccgccgcgcccgcgcgctgtgctgccgccagcttctccgggaacccgcccgcggctcccgattccttggtaagcagaaatgccgcatccacttccttcagcatggcataattcatttcttccgaaaaagggccctgcatgcagatgatatgtctgccgtcaagtcccagctccatgcatttttccagcatggcggggattggaaggattctggcatatacccgctccttaaaaccggtgagcgtacgcagctccttcaattccttactgcccgtggtcaccaggatgtttccctcggtgtgttccagccaggcggcggcagaaccgatatcttctacctccgtcagcttttccgcttcccggttcttatcccctgccgggcaggaagcgcgcaggacgcggatataagggatatgtacacggctgctggcctcccgtatattttccgtcgccgcagatgcatagggatgcgtggcgtcaatcaccagcgccggagcatatgccttcatctgttcttccatttcttcccggtccaggcatcctgtgtgaatccgggctgtgccgcctgtttcctctttcccatgggaaaggagctgttccccataggctgtcgtcacgaaaaccatggctttaaaaccctctgcttccaggaattcgtataaaagtctgccttctgttgttccggcaaacagcattaccttctgtttcatacctcttttacgcctgctccttttccgtttccaaccggtatcccctgggagtcaccattttcccgtggatattcctggtatggctgtttccgataaatacggtagtaaacatatccacctgtgtatcccgcagttcttccaacgtggtcaccaccgctttttccccttctctgcctatattctgcacatagccgcagaccgtctgcccggaacgcttctccaggacaatatcgcaggccatccgcagatagtccccccgcttcctgctggaagggttgtatatgcacagaaccgtatcgctttcggcgccgctgcggattctgtcctggataacctccatgggcgtgagcagatcgctcaggctcacggtgagaaaatcatgggaaagaggcgctcccagcagggctcccccactggcggccgccgtcacgccagcgatgacatggatccgttccgcaaacccttcttcctgttccgccagctcataaacaaggctcgccattccataaatcccgctgtctccgctgcataccagtgatacctttttccccttcttctcttcctcaatggcaatgcggcaccgctctttctcctgcttcatgggagtcacgaggaactccttgccggggaaccagggacggatgatatccacataggtcgtatatccgataatcaaatcactttcctgaagggctctgtccgcttccacggtcatctgctcatagcttccggggccaaaacctactatatataacatgcctttatccttcctttatcgtaactgttccttcacagctacccattttctttctctgtgtctgcaaagtgaagtgtcggaacctcctgacgggcgatggctatggtcacaccgctgcccgccctttttcccaccagcagttccccgccgccgcttcccagaacggccgcgcgctcacatacattatccactcccaccgttttctccacgaaggaggaaccatggaaagtgcccggtacccgctccagttcttcgggcgtgtaagtgaggaaaggcacccgccttgccagcgcttcttcctgaattcccggttcttctctcttcaggctgaccgatgccagacgtgcaatcctgccttcccaaaggccgttttcttccaggacacggttgaggcagcgggtaatttcctctctggctattcccttcctgctgccgattcccactgtcagatccctgggggcaagaaaacaggtgatgggaaatatctgcttatccgcgtctgccgaaattacaatcccgcattccggcttcctggcatcctccttttctttttccgaaaaaagaagcagcgaagaaggcagttccccttcccagggaatttcgctgtaaaatcctgctttttccccgtgaagcagccttccggacacctcccggatagcttccgtattccttaccgccaggccattttcccgggcaaacagatctaccgcaaagatcccgtttaaatccgttgctgttgtgatgacaggctccgcccccgtgagaagcgctatacgcctgcaccactcattcgctccgcccagatggccggacaacagggaaatcacatgataggcgcattcatccatcacaagaacggccggatcctgcgcttttccccggataaagggggcaacggccctcactgcgattcctgcagctccgataaaaagaagcagatcacaggaggaaaaaagggattccataagttccctgacatgagaaaagggctccagcccttcctccccatatttataaaagccatacccggtacagcaaatatcctccgaccggagccgatccgtaattacccggttccatctgccgcctttcccggtaaaagaaatcaccgccgctttcatttctggccttcatcctttcttccctgtcggaattcggtggtaaattcagccgcatacagtctggaaagttcatactcgctctccagtaccttccctaccacaatcagcgccgttttccggataccggcccgttccgccagctccggcagctcgtccaggacaccccgcacgattttttcatcctcccaggtcgccttataacagatggcacagggcgtatccggcgccaggcctcctgccagcagttcttctcgcacctgcaccagaagccctgtgctcaggaaaagaaccatggtgctttgatgggccgccaggcttctcagcttttccctctcgggtaccggcgtcctgccctccattctcgtaatgatgaccgtctgggaaatgcccggcagggtatattccgcctgcagggacgccgccgctccgcagaagctgctgacgccggggcatacctcataggaaatcccttcttcctccaggcggtccatctgctcccggatcgcgccgtacagacagggatcgcccgtatggagacggactattttcttttcttccttttccccctgtatcatcacatccaccacttcctccagcgtcatcagggcgctgttgtagatccggcaatgagacggtgccgcctcaagcagctccttatttaccagggaacccgcataaataataatatccgcttccttcagaagcgcctgtcctctgactgttatcaggtccggcgctcccggccctgcccctacaaaatgaaccattttccgttctcctattcctgttgtaattccgccaaaaggatatccgctccctttgtttttcctaaaattccgtaaacattggaaaataccaccgcctcagcctgcagctttccgccggtcctgtgttccaggtgatatgtaattttttccatgagggtttccatggttttctcaagccagccgcagccatgcaggatatccagcgcctcctccgtggtattggctcccagcagcgccgctgccgtccctgccccgccgcctgccagaatcagactggcagccagcgtttccagacgggcgtccgcccagcgggaatgggtgttcatcacacccgcccccagctttaccagctttccgatatgcccgaccagaagaagcccttcaaaccctatggtaattgccttatccagggattcccctatataattgctgcacttcacgcttttctgcggatcgatacccagctcatcccgaaggaaatccatgccgtaattgccgggcgtgagaaggatccgctttcttcccactgccgcagcctgtttcatttccacttctatggtatcaagcagggcggcttcactcataggctccacaattcccgtggtgcccaggatcgaaatccccccttcaatccccagacggggattaaaagtccttcccgcaagagcttcgccttccggtatggaaataaccacccggattccgccctcatagccctgtccggcgcagacctcctgcaccgccacggttatcatcctccggggaaccgtattgatggcggcttctcctaccggctgatccaggcccggacgggtaactcttcccacgccggtaccgccgtctatccggatcccatcctttgttttttccgcggaagcataaaccaatatgccgttggttacatccggatcatccccgctgtctttacggatcgcgcaggacacccttccctcttcctcccggatatcctccacctccaaaaacagcttctgcccggaaggcgtttccagctccacggtttccggtcttatgccgccgacgagaagcagggctgcggccttggcagcagccgccgcacaggagcctgtggtataaccgcagcgaaggcgtttctgattcttatatacatatttttcaaacaagctgctctctccttttccggttctgcccgtaatcgttcagacaaatctgagccgctgcgttatttcaccactaccgtagtaaaatagctgcttccctccggtatctcgccggaggcaggcaggaaatgttctccgggcaggccgcagttgcctgctataaccgcccgatcctccagccccttttcttccagataccgccgcaggttttccagctttcccccgcttttcatcaataccttcgttccctccagctccatatacggatccagcgcttcttttcccgcaggaatcaccatcaggacctgcgaaccggaaacaagaggctttcccgtcttagccgcaatatcacagaaacagggcacaccggcgcatacccttaccgggaatccggcccgtgccacccgttctcccacataagaaaaggtggaataaatggaaatatccccgatgttaagcatagctacattctgccccttttccagatattccgcaagcaatcctgcgattctgtcataatttttatcgagaacctccttgtcccgggtcatgggaaaatccgtataaacgatttccttacccctgatgtcggcggcctgctttacaatagaaagcgcgagggtattttccccttttgtacggggtaccgccagaaccgggcattcctttatcagccgcacggccttgagcgtaatcagctccggatcacccgggccaacgctgacaccgtacagcacccccgtatttttttcttccagcttctgtaaatgcctgatataaaggccgcgtatttccgggtactcacccattcccctgaccacgcaccgcacctggaagccctgttcctccagcctgcttttccagctgtccggcccgtctcctgccatatccgtatgggcatgatccccggcgaccagcataagcggtgtcaataccaccttccggtacccgctctcccgcagctgttttatcacctcttccaaatccgggcttgcttccaccgtccccaggaatacatccttacagcccatgcggttccagatatcctgaagccgcgcataaaccgcattgttttcatgacgggagccgtgtcccatcagaaccagcgcttccccctcttccctggaaaaacgagaggcatagaaggacgccacacgttccagatcctcctcctcatgcagcaggggcacgccgatttccatcctgcggaaacgctcccggaacccttccgcctgggcacagagcttttcatactcttcccctgccagcagatgcgtcggctggatgaggacctcctctatcccctcctccgccatctcagcaagcgcccccatcgtatcgggaatctccacccccctctccttccatatacgcatgataatcgcgctggtaaaagccctttttaccggcatataaggaaatactcccgcaaaatcctcttccagcgcgcctatcgtccgcctgcaagaatcctcataactagtcccaaaactgaccgccaatatccctctttttctcctctgttccacgcttactccttttacggcacaatgccgcctttatttaatgataacattccttccctctctgtccgttgagcctgtgcctgcgtccctggcccgtgcgcccaatccctccgcggcagcggccggacgtgcagaggatcctgtaaggggcgttataaactcgccggtccttaggctgcgtcctttgcagccttagtaccgctgcgtgtttatccgagcgagagcgtcccctttaaggacctctgcacgtccggccgctgccgcggagggattgggcgcacgggccagggacgcaggcacaggctcaacggacagagagggaaggaatgtctacctccagtcaaaaaaataccgctttccgcagcataaatgcatacgaaaaccggtatgaaatgcagatctgtattctccgcccggagaaggcctgcttttcgcacccggtcatcgctcgtaaccggtgcagggaacatgcgcagcatgctccccttatgaagggcaggtcttctggctccggtatcattatcgtatcacgccttcccggtttcccagtggcttatttgatacgactcctccgttacagcggcgggaccgcaagggctttgcacccttttccctattatcctgcgcggctcggccggcaggcacctcttcatattattcttttgtctttctcgtattatattacggaaataagacggaagcaatcgtttcttttaccttttgcattttctttggcagctgcggttactgtttccggccctggtgctgacacatcaaacggcaaaaattatttttaatcggcaaacacatcatccagccaatccagaattgtattcatagccaacatatgattgccggtctggcaatgctgttccccaccctctgcttccgtaaacagacggctcgttacggatttatcactgtgcaccttttctttcagcctccagaactgactgaggggaatataatggtctttttcccctgccaataataagatatcctgtgtataatgtccggttattccattcaaattatgttcggcaagcttttgataaaactcataggctgtttttgttcctgtaatgtaagttccctgtgaaaggccccagtcggccagaatactttttttacagagcaggcctgtaacgacatttatgataccggcccattgcttccgataagcgagtctgatcaaagaagaaaccggggccgggaaaatattggtcattacctcaaacccattatccatcacatcataagccacagccgcagcaatccttttttcaaaggcggcactccggagtgcaaaataccctccccaggatatcccgatcatggcacaccgatttaagccgtaaaaatctatcaccgcagagaccggtttttcaaaatcatatcgaaaatacatgttctgatgcaggcaaactccctgtccggggccttcaaacaaaattaccgtatatcctctttccgcccatgtgccgacctgcagaacaaactcttccataaaagaatcatatccgccgcagacaagaaccgttcctttcgaatcggaagcaggtattacaatactgttcagcattccctcttcaaacggaatctcatctttcctgtatgagagatgaagctccgaatcgaagcccttataaaaatattcgatgcattttagataagtctgcattttctgcggattatccgctttcatgaaaaactctgccatacggtagtaataggcggcatgaagccagcgcttctctctttccgccttttctgcaagggtaagccatgcctgattccactgcgcaaacgtacggacagaggataagctttccgtcacctcctgccggctgcaggcggcatccccgtaggtcaatacccggtttatctggaagttgaactgcttaatcggattaacgtattcatatgccatagtaaaattccttcctttcttaatgttaagttacttaacagacagggtaaaaaaacaaactttgccggcgccgtctataataaggatttccacagctgctgcatatccccaaaaagccgcactaaagtatccatggtatcaggagggtatttctcaaaaatagcagacagctgttcctgtagccattgatgctgtttttcatgttcggcacggacgtcctctcctttttgggtaagttccagaacgacttcattttccgtttccggagagggcttctttatgatgtatcccttttttaccagcttgcttaccatctgtgaaacagcgcttttggagattccctgctttttggcaagggccgttatgtttattccttcctgcaccccgactgcggcaaccgtatgaatctcagacagacacaattcctgatccgccgtatgtaaatgcttctccaactgcccatattggttaactgtctgcagaaatacattacaaatcaggtccatatcgataggttcgttcatctgccgtcctccttgtgttaagttacttaacagtatagagtgcttttcatgcaaagtcaacctaaagttattgacaccttaagcattaccttttaaagcagtgaaattttctccatgacctgttttctcatttcttccgtaacctttacaatttcctcaatgtccgccctggtcaccccgtcataatgaatccccgcagttaccgcgacaggcataccggtctgcctgttcagggaagccgcccagctctcactgagcgcagcttccctgtgtcccggaaaaagaatggtctccagccgcttatcgcaggatacagcgctgacggcgccgatatgaggaaggtcgcctccgtagagatccacgcggatcccctggtccagcacaagaacagaggcagttattcttctgcctctccattctccgttacatgcaaaagtcttcatccattccctcccatctgtgatagccctctccttccattccgaacaaatccagaatttttcccgtgatatgcttcacacagcagtccagcgaatccggatggttatagaagcttaataccgggggcagaatgaccgcccccatccggctgagttcatacatattacgcaggtggatagaactcagagggcattccctcgtcacaagaaccagccttctgcgctccttcagcgtcacatccgctgccctcagcagcaggttatcactgtagccggacgcgatccccgccacggttttcatgctgcagggaactacaatcatgccatccgttcggaagcttccgctggcgggggccgcacctatattatggctgtcatggacataatccgccattttttccagctgctcaggcttctgtccggtctccctgcgcagggtctgcacggctccgtccgtataaatcagatgggtctctgtctgttcccggcatccttccagctgccggagcagctccagcgcgaggggcgtgccggaagccccgctgattcccacgattatcctttttttatccacttttccggatccacctccataaattccgcacgtctgaaccgttccttcatccggaacggaaccgtgcagtcaaagatcgttttacaggaaatccccacatccgggatggaggagctgtaatcaggccgctggctgggatccaggggatggcaccttacgcccggaataaaaatcgtgtccacatccccctgataccgggtgttcagcgcccacagcacatcatccgtatcaaaaatatccacatcctcgtccaccagaatggcatgctttaattcggaaaacgcactgaatgccagcagcgcagcctgacgctgcctgccctcatcgctgggctgcttcttggcaatctggagaatcaccatatatttgccgcctcctgaagggtgggcatatacgttcctcagccgccccggcatggctctttctatcatggaataaatactggcctccgtacagattcctgccatattcacatgctccatccccgggccgatacaggtctgcagaatcggatttctgcgatgggtcaccgccctgacacggatcagcctgcattcttcgctggccggtcctgtgtagcccgggaattccggcatggcataaccggtattgttgccctgatcttcacggattctctttccgggaaggatttccccttcgatgacatattccgcattggcaatggcattttcctgtatggtcaggcagggacacagcctgaccggctgcctgcgcagcgcccctgctatggacagttcattaaatcccagaggggtggtaggcggttcaaaacaggaagtgagggagatagccggatccacgccgatgctgatggatatcggcagggactgccccagctcctcggcccgttccgccatagccccgatatgtctggcgcccggagtgaaaaaaatggacagctcctcttttccctgaaggcacatgcggtgtatggtcacatcgcttacccctgtatccgggtggctggcatagcacatgcccatagtgatataagggccggcatccacaggtgtgttggtcggtgcgggaagcagtctgcgcaggtcaaagccttcctcataagcgtaatgcaccacttcctgacaggatgctttttcccgcgataccaccggagggatcgggttctgtgcacactcgcacaataactgtcccagagactccggcggacatcccagcaaaaggcctgttctcttcctgctccccaggattccaatcaccgccgacgcctccgggaagcccttcaggttatgaaataccatagccgggccgtttacccctgtcggccgtttcacggttccgcctgctcccacataccggtaaacaccggacaattccgccatagtatccaccggcacatctgtttctataagctggccttcttccccacgcagtacctgcagcgctgtccgaagatccaaaatttccgttctgttatccatagccgctcctttcattccctgcagatgccgtcaatccaggcaaagagttccggcagatcataatctcccgcatgaggcagtccccagggaagatgataatccacctgaataccctgctcccggagtgccgctgccagcagtgcggagactgccagagaggtgtctctgtcggaagctccatgacggatgcggaaatagggcgcggtatcacatgttttatcaccaatataattcatcgggttcatcctgcggatctgcccttcctccgccatggctccgcccgctttgctatgctccaggctgaaccttgtaaaatggcgggatgccgtcgttttattcccaaacagttcattttccggtgtcgtcaaagcaacttcatcaaaggccggcgtagtcttcatccttgtgcggtacgccacatactgttcaaaatccacatccacagcttttcctttccggacagtaatccatgggaaaccggaaaaatccgttccttcctccatcgccttttgtatggattccataacccggacttttacatattctttaaagcttccgtttccatcctcttctaattttaagcagtttcccttttcatctttcaaatgtaaaccattaacatatgcaggaaataaaatcttaagctcatccgacatttttctttgttccggcgactgtattcccgtcaggggaaccatctttctttctcctgtcttctcatcccggatcccatgcattctctgatagttatcgtaaccgttaaattcccattcataggccatatccccatgctccaggtttgtaatagggcaatagcaggacgctgcaaaaatatcatcctccgcacaggcagcaccggcttcttcaaggaagctttcataatccggatggttccccgtcactcccagcagcgcagagagcgcgcctcccgcgctcgttccattggaaataatatgggacatgctgccgcagatccgatccctgttatatttaagatacctcacagcggctttcaaatccacaatacaggccggcgcacagccgataaagctgccgtcctcacccgtaagccctctgcccctcgctcccacagatacggccacataaccatgcagcagcgcctgaaaaagcgtatttgtccttcccaaatgattgtttcccggtttctccggttttcccggcatataaccgcccactgtgttggcaaggaaaacaggcgctgtatttctgtcatatgctccgatggagcctccttcccaataggcttcaggaatatatatgttcattttctgatattccggagccgacggtcttttcacataaaccaaatcctcatatgccctgtataccagcctctttccttcctcctctgcggtttccacccggtatctgtccggattaaattccagatcgtattccatttcttatcctctcttccctttctgtcctttgctgccgtccggcctgcccgctgtaccggaattctttccgggacaggggcatgggcgaaggttgcatttcttatattataaagaaaacacggattgccaggcaattcgaaaaaggatataatatattccaaataagaataaataggagttctcatgaatatagactatctgaaggaatttgtggtacttgctgataacggcagcttttccagggcagcggaggttcttttcctctcgcagtccagcctgtccaagcatataaaggcgctggaacaggagcttgatgtcctccttttcaggcggaccacacgctgccttgagcttacggaggagggggaggtatttctttcctatgcccgccggatatcccgtctgcaatatgaatatcagaccgctctttaccattcccgtcagaaaaaaagttccactctcaccataggttccattccggtaatggctcagtatggcattacggataccatcctgctttttcatcagagcaattcctcttttcatgtaaatgtgctggaagaagaatccacggttctgaagcagatgctgcgaaacggccagtgtgagctggcatttatccgggaagggcaggaaacggaaccggattttgtccatattcctttcgctgcggactgtctcgccgccgtatgcagcagtgcttctcgcttcggagaggaaaaacagcttcttctctcctcactaaaaaaagaaaagctccttcttttgaatgaaggaactcttctttattcactctgtatcagcgcctgtgaagaggccggctttacgccgaatgtttcttataccagccatcggatcgaaaatatcattgatctggtttccaaaaatatgggaaccgcccttctgatgcagaaacaggcttcttactatgccaggaactcagatatcaggataatccccatccatccggagcttgaaacccacatagatctttgttatttaaaggggcataccctgtcgcctattgccagacacttcgtttcctgtgtttatctcagcggggagcagggaaaccatgacatacctgcgcccgcccggaattataccacaaaggtatgaagggaatgggcccctatgactgcggaaaaactccgctccttatggcagaagctgaaggcacggtcgtgatgcatgctgttcatcaccgttatcaccagctgtccgtcaggattctcaaataccatggcatttgaagtccagtgtccttttgtatccagcagccttgcccctggcttgataaaatgggaaaaatgcttcatcaggtaaaattccggctgcagttgccagagaattctgagaccatccccagctggaaacaccgccctccgaaagcgccatattccaataagtatacctctccgcaccatgacggaaaaagtaccacatgaggaaataaatatattccgcctgctcccattcattcctgccgtccccgcattcgctctccgtctgcatgatatgcatttccgggaagctggcttcaatctgctccagctggtgctttccgccccactgaactcccacgccggtcagatatttccgggcgtccttgtcgcttaatatggtattggcgaactgatcataaaactcttcataagaagcgccaaagcctgagcggaaatctgaaaaaggcccattgatcgtccccagccagatctgggtgtccaggccgcttttttcaaaagcaggccccagatagcctttgataaaatcgcgcatatcactgccatgccagagacaggaaggaaatttctgatccgccatgggctcgttctgcacatgcaccatggaaacagggattcccagttctttataagcttccacgaatttcacgaaataccgggcataggcatccagcaccggctcttccatgcgtattcttccaaaattgtataccttctttgttttcatccacgccggagggctccatggagaggcaaacaaagtcaaatccgggcagtatttctgcgccgcacggatgtaaggcaccgtgtatttcttatcccgttccacgttaaaatccttcagctcatagtcgccgtccgtatcatcacagctgtaccattccaggctgaagtcattggcgccgatggggacacgtcccatattgaaggcacagccttcggctccgtacagctccttcagaaagccttccctcacttcctccttcgttttctgaagggcatcccagcccagttcattaaaacagccgccgaagccaagaatttcctggcgcttttctccgatcagctccagggtgtcctcatacatccggtccttttctacttcttcttttttccaatagtccttttccttactgacaatgtgaatcacttcgttcatatattccttcccctttcccgataatgaacagcttgtgtctttattttaatctttttcaggcggggggaaaaggtgttttttttacggaataacctgtcgatttctactttccggaacatacgcataagcagcaacgctttccggctttttcattcatgtatcaatccgaaatgccttgccagcacttccatcgtttccaaacgggtatccgtccgttcatcctctctgataattgtaaaaaagccgctgttaagccattcatcatatatttctctgctgttcactgcggctatacattcccgaaagttccccatggttttctccggatccggggactgcctgatctgagataacaggaactgcttctcttcatcttccctgtcaaaaaacctgtcgactgaggggaaagcatgaccgcaacctgattataatcagctatctgcctgaggatatccaaaggtatattcgtatcgactatcgtttttctatcgccggacagacgtatcaattccgcgatttcaaagtccgccgcttcatagctgttgcccctaatccaggccagatattcatccggagttctattgacaaattcctgccagtccttcatcgtattgaaataactcaaattgggctgttcctccggtgtgatgatctgcagcattctgtccaatccgtaattttcaccgcataacagcaggtgatacttttccgcaagcatcttgcacatggttgattttcctgcatatgcagtgccatttataaaaaaacagtttttcaaataagccttcagtatattattattgatattcattcttttctccttttgtataacaacaaagcctgtagattacaggcacataagaatattcagttgtccttacttatctgattctattgttgttatacaaaaaatggcaccacattatactttcctcccaaaatattaaatttacatggttccgaagcttccgcacccgttgtctctaactcttctttccgccgcgtaccttaccgggcgtacagccgtaaacctgccggaacatacgcataaacagcttataattataaaaaccatgcctttcctgcagctcgccgacaggcaaatctgtatacagcagatccgtataaatatgttccaggcggatcctgttcacatattccagataggggatccccatctgctccctgaaaaaccgggaaaaataagcgggattcagcccgatttcaccggctatgcggctaagaggcagctcttcccggtaatggctgcggatatattccataattctgcgtatccgttccaggttcttttccgacttcattcgatcctgcctggatatcttccgggaaaaataacgtacgagaagatgcataattgaaaagataaggctgtagcactgaaaaatatatccttcctccgcctgcagatatacgacgcccaattcttttatcccgtcgcgaagcctgccgtacgcttcataaatctgcggatctcctgtttcatataccttttcttcttccacccggaacataaggcaatggatgtccggcatgaatttttccagccatgccatgggtatctggagcaagatagccgtatttccttccctgcacctggtggaatggatgcacatcgggtccagcaccacaaaatcattttccttcagaagacaccgttcattattctcttccacctccagcgtacccttcagcagatatacaatttccagccagtcatggtaatgcttattgaccacgctgccgctgtcaacagagaaatccagcttaaaatccatggcatcattgggactgatgatttcatgcatgcacttttccactccgccgcgccccttctttatcttaattcctgcagtaattgaactggccgaatattttcattccttctgctaattatattttgttttttcgtattccacaagtcctaacttttttcttatcttttctcataatctttccgtctaaggagttacagttccttccatctatgacatgccgtccgttttctcactctaagcagtctgcgcaggacgcagcaaacaggcggtacttcgtcctaaaccaaagtatcgcctgttatgtgcctatttttatttcgtagtaaagcttatggaatccgtcttaaacagactctgataactatcgttgtccatcaccgaaaacttcaattccacttcatccacactggtaatattattctcttccaaatcactggagaaaatggttagttcatccacagccatcttcccgtcatacagggttgaagcgaagatgggattaatcataaacccattaatcgatacatcactgcatgtaacgctgattgtttttccggtattattctccagatacaaaagaatgcctgctccccagaagctgtcctcatccacatatttacccacgatacggaggccatcctgatttaccagttccttgccttcgtctgcggggctggtatccatattggggaaatccgaagtctggatgaccactttatcaaatttagttattgtttcatagctgctactgtcataacttttaaaataaatttcaatctggccgatattatcgattcccgccgctttcagggcggaagcggacaggttcatggtttcgttggagcttttcccggccgcaacctgagcggaaaataaatcagatatcatataattattcacaatcagggcatcgcatccgatccccagatccttatccgtactgttctctatcagcaatttcagcccggttccgaaaatcgtatcttcttccagccccatggctgtaatttttacaccgtcctgatcaatcagcacctgttcctcgatggtcggcagaccgcttttttccgctgtttcctctttgttttcctctgaagccgcttccgcagccttactgtccgtatcctcagctattgtcttttgagaaccggaatccgaacttccgcttcctgccgccatcataagaaatactgccagtaccgccgtaaccgctatcccttttattgttttccttttcatattgtcctcctcgtttttctttgtgtctttttatcaaaaaggctgccggtatcatggccagccattccaatactatgtcccatatatcaaaggttccggtaaggatacctgccagctgcaggaattccgacaatccggcaaacaccatacacccggcggttatccttcccaggcttccctcctctctccatatcaggcacacagaaaataccaatgcataagcccaggccatatcacataagtgattcctggcgaagctttgtattattccgtttcctgcttccggcaggtattccagaggaagccactgctccgccagcttcagtatgcggatgtctcttccgcagaatacataaaccagcagccccaacagcaatgccattccgatatgaactccataaaaaatagaagctctccatttatctcccatgtctttcctgcccttctgaaaaaaagaagaagaatccctacatcaaagatataggaattcttcttctttttggtatgcccgcagcatacaacagcccgtcaccgtcttcgttatttcggcagagaggtttccaggcccatccccgcataagccaaagctactgttaaaatgatccttatcaccagcaccacatccttattccaccgggaaaaagggaatattttcctgtcccactcgcaaaagtttgtgataaccagtaaagggatccacatcatcataaggcaggaaagaccttccagcaaaaatcccggcacccctgctttctcagcgccattgcccaaaagcaccgccgtaaacagggtcataaaaatatacaccgctattgcaatcgcttttttccagatctttcctgtacgaaaccccggaataatggctttcttacccggatccttttcctcctccggcgctttctcaggctccgtaccgttcatcttttccggcatcagggcctgggttaattcatggacgttctgataccggtcattgggatcaatctgaatacatttacggatgattcctcctgtccgtccgccgggaatgaccactgtagggatttttcctgtaatcatcacattcagcagcacaccgatactgtaaatgtccgttctgggatccgtctgcgcaaaaccgaactgttccggcgccgcaaagccaacggttcccaggatcgttgtatccgcagtctgatttcttttcacattgcgtgctatgcccatatccagaatcttaaccactttatcggaggatatcagcacattccccggatggatatcccgatgtaccatgcccaggctatgaataaactccagtcctttcagcagctgcagaataatgggaaccgcttcctgctccggaagcatccccctctgattcagcagttcctgaagcgtgattccgctgatgtattccgtaataaccacacattgatccttcatgattatcacatcccataccggcgccacattgggatggggcttgttcttcagcttctcatatatcatcccctgcgcccggggcataatcttcttaatcacaagcctgccgtccgacacccgtctggccagcaccgtcctgtcttcctcccccgatgccagttcgagtatatcctcataattttccttcatatattcagaacggatttcttcagacatatgtgctgcattatccatattgcttgttcctttctgcattttcctttgtaacggattcttaattacttgactccggttttggcaccggctacaatgtatttgcatctataactataaagaaggattgggaattgatcaatgaaaaaatcaacacaggaattatttgacctgatgaaaaagacacaggcttttgatacatatatggaaatcaccaaagaagaaagagtggaaacgaccgtttccgctgccctggaaaaattgctggaggaaaaaaacatcaataaaagcaaatgtattgaggcctccggcctggacaggacctatgcctaccagattttttcaggaatcaagacgccatcccgcgataaactgctggcactctgcctgggtatgggactcacgctggaggaaacccagacgctgctgaagcagaccggatatcctcctctctatccacggacggaaagagactgcgccattatacatgccctgtaccaaaatcttaccatcgtaaatctgaatgaactgctgtatgaaatgggtctggaaatcatcagctaggcttttgcagaggatacttccttcccgtacaggattggaatatccgggatatccgttattttttccacttcaaaatctgccagggaacgatcgaagccaaaacggtcgtcaatcacggctgccacctgcattcccgccagatgggcggcagttattccggcggtggaatcctccgccaccaggcaatccttcgtatcgattccaagcgccgcagccgtatggatataaatttccggatccggcttgcttttccgaaagctttctccgctgaccactacttcaaaaaaatcccttatcccattatctctgagaattttttccacaatagccaaaccattggaagaagccagggccagccgaaggcccttttcctgcagcttccgaaggacatccggcgcctccttccggaatacttccgtaaaatccatagacggataggtgacaaccaccttctctttgtattccgccagaagctcctgccatgtcattccattgtccacggctttcgccacaatcccccaacttccctcggaggaacgccccacggttgggtatagttcctccagggtcacctccggattttttccttttgcaaactgataccgcaggttcagatagagcatttcactgtctaccagcaccccgtccatatcaaaaatcactgcccgaatcataacctgtttcctctttccgcttcttccgccgtaatatttcaaaaccctgagccgttagcttctgcccatattccggtcagaattcttcctttagtatcattcggatctcccctaattcaaggcctgactgtccgaaatagaacttcatatattgatgagggaacctgaattctcccaaatccgcgctgcgcgttacccattctccatccgtcccattcatggtaaaggtgatcacgactccatggttcataaaaacagacatgggaacctgagccagttctcccgcactgcatctggcagtaacctgcatcgcataaacacccttatgaagcagcttcacccctaatacagtagatgctcctttttccgtggagagagaagaaatgtccagtgccgtatcccggccgacttcctggtataccagatccagaaattgggcatcttccccggccccttcccgctgctctctcaattcctcttccgatatgcgatccaggaaacgatccatcaccggcagacgcatcaataccctgcagatgttccgggcgctgcgaagcagctcccccctggtaatcctgccgtccgccagcccttccatcgtgttgtcctctccggtattggcctgcgcatcggaaaccaccatatacaggtcattctgtgccctgaccatcgccgctgtattccgtgtgtccccttcttctccttcctcattcatcttcgcccaccagtccgtcataaccagaccgtcaaagccccattccttccgaaggattgtggtgagcagatcatagcttccggcagtccacagaccgttcaccggcccgtaggtactcatgacggaaagagcttttccctccttcactgcgatttcaaagcccttcaggtatatttcacgcagcgccctctccgaaatgaccgcatttgccaggttccgcgaatattcctggttatttcccgcaaaatgcttaatcgttccgctggttcccgcttttcccatccccttcagctgggctgccgccattttgccggtaagatagggatcctcgctgaaatattcgaaattccttccgttcagaggatttctgtggatattcataccgggtcccaggagcagatccacccggttgcgtctcagttccaggccttccttctcaaacagcttctccaccagttcctcatgaaaggtacaggctagggaggtaccattaggcaggctgaaggcatgtgtgccgcagtccatacggataccggaagggccgtccgcacagcagccagccgggatgccgaaatgctgcagacgatccgtgacgccgccgaatgcgcctgccgttccgggcgtcaccttcggggaacacatcccttctccccgaacgatacaggccagatcctcatccgtcagctgggcgagaaaatcctccatatcagctcttccgtcatagacatctccgagaaggatgcccctgtcaccggtgcagacaggtgatgcaggcctgttttccagaatccgctgcgccaaatccacacttcttaagggcgctgcttccttctgcatacagaaggagtctccctctcccacaggcttcatcctgcaaaaaggagtaacaggagccagcgcttcctccaggcgttcggtcacggtaagtgtctcctgaacaaaggctcctgcaaaagaagcgctccgcacatccgttcccacatagaaaccatagcatccttcctccagcacatagcaggatttatgtccggtaacaccgctgtcatcataggaagccagctcttttttagaaatacggaaggaaagaatctcttccccgtccggctgaatcacttccgttttccggaaggccgccaggctgcggagaggttttcccagccgcccctgcggaggattcgcataaacctgcacgacttcttttcctgccgagtctcctgtatttttcacacggacctgcagcagaatatcctctccttcttcccggaaactttccgttgttaccgcaaacttcgtataggacaggccaaaaccgaaaggatagagtaccttatccctggctgccgtttcaaagtaacggtaacccacgtaaatatcttccgcatatacattttcatattgaccgccaaaatccgctgcagaaggatagtcctctatggaagccgcaatggtatcgctcagctttccgcagggactgactcttccggtaagcacatccgccacgccgttcccgccttccataccgccctgccatacataaaggacagcggaaggcgcacagtcctccacccatttcatatcgataatgtttcccacattcagcaggaccgccgtccttgcaaaatgtctgctgaccgtccggatcatggctttttctttttccgtaagcagataactgcccggttccgcctttgtatcctgatcctctcccgccgtacgtccgataatcaccagcgcggcatcactcacttgtgccgcacgcgccgctgttttatcgtccagaggcatttcctcctgggaccagggttcctgcccccatcccttccctttgtcaaaaggatgttccgcacaccacgcttcgtatacaccggccagttcttcatttacccggatggatccttccgcacggagcgcatccagaattccggtcacataacgggtattcaccagaccgcccgaaccggtgccgcttttataatatgtaaactgtattcttccgaataccgatacgttttccccttctcttaccggcagcgtattgttttcattcttcagcaatacacagccctccgctgccgcctgtctcgccagccccttatattcttccatatccagataatatttccccatggttccctcctgttcttttcatactcttccattatacataaaaaaagcgtccggtaaatatgatttttaccggatcgcttttcttaccgcagtctttgtgctattctcatccatcaggaaatatggctaattaataacctgcagccctgctttttccattctttcttttaaatatgccacactctgcagatactctgaatccgaatgaagatgctctataatcataggcatctcaggattcactttttctgccagacgggcatatttttccaggttcaggattccttctccgcaggctacttctttcagctggaaggtaaattcctcctgaaggcatacgtccttaatatggcagctctttatataactgcccagcctgtcaaaacaggtttccataaacgcttcgttcccgaagtatttttccggactggtgatccaattggccaaatccatatgtacgccgaaatgttttctgtccacctcggctaacagggcggcatactcttccggattggccggagccatccagggcatgggctccaccgtatagaaggtattctccggttcggccctgtcaataatttcctgaatggaacgcacggttttcttccagtgttcctgcgtgaaattgcccggataagccccgtcccaccggcttccgcagcttcccgttatgttaacgcagcatgcagcgccgattctgtccgcaagcttcagctggccgacacagcgctccattgcagcctgccgctcctgctcatctgcagcaaggggattacaccaggcaccaacctcggcaatgacaaggccttcctcaccggccgcctgtacataagcgttaaccagctcctcagaagccgtataatccacaggaaataccacggcgccgcagcccagctccttcatcctgcgcgcccattgtccgggattgtcatgttccaatgatgaagataatccaatacgcataattactccttatttcttatcgctctccagcagttcaatcagcaccttcaaatccttcgtcgcagacagataggcatatcttccgtccccgcttccgtattctcctttctgctccagagtcattccgaattccttacagttgtcaacagcctgctgcatattcattcccgccacattaaaagcgagatgatgtacgccctctccgtgctcgtccaggaattctctccaggtggagggttcctcattgggctgaatcaattccagctgcaggcccggtcccacatcaaaaaaggccagaaggctctgcgccccgggagcgggctttcctttgtattccgtctgtgtcaccgcataatctcccgcttccaccgcgggcggctcctccacaccgagaaactctgcccatttcttctttgtttcataaatatccttaacaataaatcctacctgtgctaccaggtttgttccaacaactccgctcatattttctcctttcatttttggcctttatttatttgccgggccgtttttacgctattttccccggctgtaagcccttctttaatggtgcaggacggctgcactccgtacgcatatgataaatttccccgctgcgggccgcctgcataataccgttgatggcttccgtcacatggactgccagcttagcacctccgcggttttcttcccgggatactatggcatatgccagatccagcacaccggctcctcttgtatattcgcctgttgaaggataatattccttcagcatttcttctgattatacttcacatttacaatgacatcttcatacgtcattaagcaaacctatatttctatcctttcgatcgtatgcataactttttccacatttttttcctgaagataaaacggattcaagatatgctttgtatatttcatatgagtatcagccgttttattaattaaaactttcgtaaaatacctttcccagctaaaattttctgaactctcaatataattatatggctcatccaaaagtttctttaaatcagaatcctgcaaaattccactctttaggagcaaccattcaaaagactccggcaaatataaatgaaatcggtcttctatctccattaactttaccattttttccatttcagaaccgaatgctgctccgtcagcaataatcaaaactatatcatccttactatttaaagcaaccataaaaatattggattttccagaagcacttatgcatggctttcctcttttcctgcataagtgattaaaaaattgaaatcctgcgttagaatcctctgtgataaccatttcaggcttgataggatgatagtaatcctgtttcccatacaaatgatataattcattataagtccgcttcaatgaaccatatttcccggaattacgaataccatatatttcctccacactatatggcagagccgacagactttctctcgctactatcacataatagttatctgtatgctgaatatacgctgcaaactccttagttccaacaaagttattaccttcatcaataaagacaatactatcctgtatggcagataactgcactttccatgtttgccctgacaaaacagcacactttttttcacttgtcaattcaataccactggctattccattttcctgaaactcccgaatcatttccacaagaaccgtttttccggtggcactgtctccgcgaataattgtaatatttctctttattacaaactcgtaacgtatacgcttattttgtataataatttgatattttcctatcatatttacacctatatataaagtccggcaattggaattaattctttcatattgtggacaatttctccggtattcaaaatatgaatggtaaagcttccttttccaaagtccataatatgccgcaaattgatggtcagttctttttcctgtgcaattttcaaaatccactttgcacaattatctccgcatgcagaagcattaaataccttttcaggttcataattcatcagtatcagtgttttcacaccaccagacaaactggtcggcgcaattttacccatgaccgggctgtcaattacggcattatccaatacccgtgatttatcaatatccataatcatttcttttgtaaaagaatctgtaatccactcatcctcatatacatttttaaagtatacggaagtattataaattacatccgccatttcaccatagaatatgtgcagcacgaaaatacctccctgatattagttgaatttatttatatactttttcgattatatcatatttttgtgaaacagaacactgccgttaaattaaggatatggggacaatgaggttatctttatcaaaggctcccaatttttcagacaggcagagtacagcgccaatacctctctgcatgaaagacttctctattactgaaaaattactgatcattttcttttccggagttgccgttttctttatttcaatgggatgcagttggccgtcaccttccatcaaaagatcaatttcctttgcatctttatcacgataatagtaaagataaggttccttgcccacattttgatagcttttttggatttcactcaccgtatagttttcgagtaaagcaccattcatcgcaccgctcattgccgtttcagaactgctccatttagtcaggtaacaaacaaggactgtatcataaaaatatattttgggcgtcttcacagtacgttttaacacattattcgagtatggatgcagatagaaaataatccccaatgtttccagaatacgcagccagctttttactgtagcctgatccatatcacagtcgtcagcaatccctttgtaattaaccatttgggaggttctggccgcaacagctgttataaaattcaaaaacttcagcgaatcaatgctgcctgacaaatcctttacatccctttccagataagtattgatataactggaataaaagatgctgcgctcctgatattttttactcaccaaggcaggcattccgcctaaaaagatacggtcaaaaatttgcggagccaaagcaggccgaacgacttgctgacgctttgaaagtacatctatatccagggaaaaggccccagcctgtccgctatatatttcttgttgggaaagaggagaaagatggaggagcgcaacccttccggccaaggactcctgaacaccatccatcagtttaaataactgagagccgatcatccaaaagtcccctgcacgctgatctctgtctgcataaattttaatataagtaaacaattccggagcatactgtatttcgtcaattaaaataggaggctgatgaatctggaaaaacatcgcgggatccgttttggccaatgcacgatcattcagatcatctaatgacacataatttctgcttcgcccttccagaacaataagtttctgaagcatggcagttttaccaacctgccggggacctgtcaccaaaattgcaggatattgcttatttaactcaagaaagatctcctccatattgcgtttaatatattccacttcaatactcctttcggctattacaggtaccaatctaattttagccgaaatcataaaaatagcaagcaaaacatatacgtacaaacgcatatgttttgcttattgcccgctatcatcctccatactacccttcatcaaacaccggcacaacaacctccgccccatcctgcatagccgacaaatgggcacagatcccggcagccgtgatattcgcccccaggacttcatcaattgccgccttccgattctccagtatactggagacaaattcatgcaccagatgcggatgggaaccatgatgcccgcccgccgcaccggaaatcagtgattcctgcggattcagcggatcataattacctcccaccgtatgcctccggatttcctccggcagcatactataataattaggcattaccgtctccctcaccacagtggttcccccgcgtttcccgtccgccgccttcacagccgttgtaatgatcggattatccccatcagaaaaaccccactcaaagctggcgtcacttccataaacaaacatcccctcctgataaaccctggccgtttcaaacagagtccgcgtagcttcccccttcagcccgttttcaaaggaaaaaatagcgctctccaccggataaggattcccatattgttcctccatcccttcctccatcgtacccgaaccaaaacaatgcaccttacatatccgcgctcccgccatagctctcataggcgctatggcatgagttccataccacatgggcggcagccccagccaataagaaggccagttcgccatatcctgataatgagacccccgcaggaactgtattttaccaaattccccctttataagcatttcccttgcataaaaaaactgcctcgtataaagcgtagtctccatcatcatataatttttcccgcttctcttcaccgcctccgtaatctccctgatttcctccagagaaaccgccatgggtaccgtacacgcgcaatgctttcccgcattcaaaaccgctgccgtctgttttgcatgaagaggaatcggagtcaccagatgaaccgcatccacttcctcatcctccaggatttcctcaaaactatgatacagcctttctatcccgtgcgccctggcaaactcctccataacgctgctgtccgtatcaaaaatcccgatactccccactcccggatgatccctataaatcgggacaaaagcccctccgaaccccagacccacaagaacaatattcagctttttcattgcaatctcctttccgagcatccggcccataacccatccgctcccatccattccataaaagatatctttcaccttcccagtataaagatcctcctgccttacgtccattgacaaaagggaaacaaaatgtatattatggaactatgaaaatcggaggtaactgccatgcccacctacacccttggctgtcaaagacagatcagcgccgcaaattacatatactacgccgatggctgcccccatcccgacagaattatgcaggagcacgattttgtatatatgataaatggagaatgggaaatccttcagaacgaagtcccctttacagcaatgaatgacgacgtgtttatccttcatgcaggccagcaccactccggcaataaaaactgcacccccggcacccgcaccatatactttcatatctcctgctctccacaggattccttcggcagcaatccctccgcccccggcaccaccttaccgcccctgatccactgcagcagcttcccccgcgtcaaactgctctttcaggagcttatttccgtccgcctctccccatccccaaacaaggacaggaaaataaatgccctatttgatttacttctcttggaactccaggactcctgcgcccaaaatccacacacacaagacaccctcctcacccaggccatcacactgaccgcccagaacccccaaaaattttacaaaacagccgacatggccctccacctcggagtctgccccaaaacactcaaccaacgcttccgggaagcctacgcaaaaaccttctaccaataccaaatggaagaaaaaatccacctggtccaacaattcctgctagactaccccgactccaaactccaaaccgtagccctcaacttcggcttttacgacgaattccacctcaacaaaatcttcaaaaaacacaccggaaccccacccggcctataccgcaaaaccctcacagcaacccccttccgccccacactcccccagggataaacgcatccgtcacaggagcccctctctgcttccgtgtctgtctccgtcctgcccctcctcccgggagccgccgtggatatgttttccgctccatctgaaaaaacggtgatgtttcttaatgctccgctgcgccggaagactgccgcccttagcggcttgtctgacgaaccggccggcccggccgccggtgaggagttctgccgcgttggcagccttccggcgcagcggaaatttagaaacaccccgtttttgaggctagagcagaaaacatacccacggcggctcccgggaggagggacaggacggagacagacacggaaacagagacagggtccctgtgacggatgcgtttatcccgccctcactgaaaataaagggtaaccaccaggcacccctcacggacggccgccccgacgcttcctcccattttttccatcagtcctttcacactggcaagccccagcccggcccctcccgtatgcctggaaggatccgcccggtaaaaacgctgaaacagcctttccgtatccagttcctccggatgttccaccggattcgtaaaatgaatggctttcccttcctgccggatcaccagcctgccgctgccatatcgaagggcattctgtaccagattggaaaaaacacgccgcagtgcctccgcagatgcataaaccattccgctttcctcctgaaaatacagttccggctccacaccggcttccgtcagcttatgataaaatcccgccagcacatcacacagcgcaggaaacggagcaatttcctcacattcaatttgatactcctcattggacagcttcgtaaataaaaaaagctcctccagcagcccctccaaatcctccagcctgcggcggacaatggctatgtagcttttctgcatatccgtatccgatatattttccagaagctgcagatatcccgccgctcctgtgagcggagtacggatatcatgagagacacaggatatggtgaatttcagttccctgctcatactttcctggcggatgcgcgcctgctgccctctttccagccgctcattcaccgcccggcagcagttcaggaaagcgcggctgcgcacactggtgcccaaccgcagattgctgtattcgtcggtttgtgtaagctgctccgcccattccttcagctgtctgtcataactccacagccgaaggactgacacaaaaagcaaaacccccattatcacaattcctattcccatactgcctcctcatttcccatcttttcttataaccgtccggataccctgagctgttaccttctctttccgtgaagacaaggtttaaatatcttttttatataaagccagaaggctcagcgccgaccagaccgcaagccagactgcggtaaccgccattgcttctccgaccgggcttccgtaagtaacatttgccgtcactgcctgcacactgccgtacagcgttttgtatactatggaaattccccagtttccaagcaatgcttccagcataaccggcacaatccctccggccagaacaatcgccgccgcaatcccgcctccttcgctgcgcagccatacactcagaaaaatcccctctgcggaaaatgccactcctataaacaaatattccacaaatactctcagataatcaaccagattgcttctcgcaaaattcatcccgcttacaacagagcatatccgaaagataaggaaacttcccagaatccacaatgcacatacgatagtcatacacagaagcttactgacataataacaccaccggcctccataaaaagaaaatatatttttggcaaacccactgctgtaatcattacagacaaacaataccacaacaatatacaaagctacgaaaataaaactgccgctgtaaatagttgtacatagagcctgtgtttccgtaagagaacgaatggactcaaaatcagtctcatcgcttgttgtaatctccacacccgactcaatcgcctgctggcgcagttccgggtcagttaccgtacgcagggtaataatggaaataagaatacctgccgcaagacagagaaaagctatgaacatcattttcacccggaacatccggcgcagatccatacgaagcatattaagcattttccccacctcccatcatttccacgaagtattcttccagatccctccggtgcagatacagttcctgaaccacaattccgtttcccgtaagcatcctgctcacctgatcgctttcacaattgtcataaataagcagctgtccctcaggccttacctcataacgggtaattcccagcccctgttccaggcacactgcggcttccttcggcttatccacccttacatgcagataatcccgacagttttcttccagctcctgcgctgtgatttcctgtaccattctgccatcccggatcacgccataacgggtcgccagcttgctcagttcacccaggatatgggaactcaacaaaatggtgattcctctttcctgattcagctttttcagaagcatgcgcacttcggacattccttccggatccagtccattgataggctcatccagaatcagaagatccggatttcccaaaagcgccatggcgattccgagacgctgcttcatacccatggaaaactgctttgttttcttcttgccggtatccgcaatccctgtcagacggagcagctcctgtactttttcttttccatccaccagccccagacaggccgccttcagcatcatattctcccgtgcgctcatattcgggtaaatcccggggctttccaccagaatacctgtcctttttctggaaatgctgtcactgaccggctttccgaaaatagatatttcccccgaagtgggagctgccagggaacacagcatcttcaacgccgtcgattttcctgctccattctttcctataaatccataaatatcgccctcatggacgcacatggacagattatccactgcccgcttctgtccataaactttacagagcgcttttgtctgtactacttccattatgtgagtacctccttgctttgatatattcagtatcgcagaaataagcagagaaatcgcaaagaaatatttaagaaagtgttaattgttattccgtcatcttaaatccaattccccacacagtctgaatatagtcctgtgccccaccggcacgcagctttgcccggatattactcacatgcacgtttatcgtcttatcttctataaaagagtcctgctgccacaccgcttcataaatctcctgctttgtgaaaaccttttttggatgccgcatcaaaagctccacaattcccagttcatgagccgtcagttcaacagccttccctcccgccttcaggacacgcgcatcctgatcaaccacccaatccttaaaaacaatctccttttcccccgccatactccccctgtgccgcagctgcacctggatccgcacccaaagttcttccagttcaaaaggcttggtaagataatcatccgcccctccaccaagaacctccaccttatcctccagcgcatttttagccgtcagcacaattaccggaatcctgctgatttcccgtatctgccgaatcaattcctctcccgaaagccccggcagcatcaaatccagaagcagcagatcaaattccttcatctgccacaaaagcctcccctcggtccccgaaaaagcctgctccaccccgcatcccttccccctcaggaattccgccgtcatattattaatatccgtatcatcctcaactaccaaaatacgaaccattttattcatcctcctgtcatccttttgcttcctcataaatactacttgatatcgacctctttcgcaacggattttatatttttccttccggcctgagaaattttcctgtcctgtgcttcgcgtctgccgcaggcctgtcctcccgctgtggactcccttcccaaccgctctatgtaccctgcgcaggcacgttctcactctgccaaaaacgcagcggtactaagattgcacagaacgcaatctaaggaccggcgtttttagaaggcctttgcagggtacatagagcggttgggaagggagtccacagcgggaggacaggcctgcggcagacgcgaagcacagggctgggatgcaaattatgaaaatcttaatattttgtaaggaaaaccattacaaacacccattcattttctgttatgataggatatgttaacaggaggaaatctttatgagggaaaaaatacttgtcgtagatgacgaacaggaaattgcagatctggtcgccctgtatctgcagggcgaaagcttcgaggtcttttcattctattctgccgcggaagcgctggaatgtatccgcagggaatcgttggatttggcaatactggatgtaatgatgccggaaatggacgggttccagctatgccggatcatccgggaacaatatacctatccggttatcatgctcaccgccaaaggggaagaaattgataaaataaccggccttaccctgggggctgacgactatatcaccaagcccttccgcccgctggaactggtagcccgggtaaaagcccagctgcggcgctataagcattacaattccggatccggtaagactgatgacatcatttcctgctccggcctgtcactgaatgtgaaaacacacgaatgtaccctgaacgaaaggccgctcactcttacacccacagaattttccatactctgcatcctttgcagccacaagggaaatgtggtgagtgcagaggaacttttccatcaggtctggggagatgaatatttcaacaaaagcaacaatacaattaccgtccatatccggcatctgcgggaaaaaatgggcgattcctttgaggagccaaaatatattaagacagtctgggggtgcggatataaaattgaagcataaattctctttttacttaaaacttatagtatctatttgtgcaggacttcttttctgcctgctgctctattacctggtggacaccatttggaacggcgctgtcctggactggtttgacaaaaattatatgcataccagaagcactgtccttaacgaaaccggtcaggaaggtttcatcagggaacccaactggtatcagctgaagaatttaatgctgcgtgtactcagcttcaccgtaagtctgtggattctttccgtctatctcatttcccggatgtatgcctcacggaaggaacaggcggcgctgcacaaaaccggtgatatgatccgcctttgtatgacccaggataatgatatctcctatatttttccggaagaatatgcaggaatttcggcgcagatcatgcagatcaaatcccagatgctccggcacgagcagattctgaaggaggaagctgctcgtaagaatgacctgattacctatcttgcccatgatctgaaaacaccgctgacctccgtcatcggttatctcagccttctggatgaagccccggacatgcctgccgaacagaaggccagatatacgcatatcgcactggacaaggccaaccggctggaaaagctgatcaacgaatttttcgaaatcacccggtataaccttcagcaaattgtactggaaaaggaacaggtagacctttattaccttctcgtacagctgaccgatgaattttatcccgcgctgactgcccatggcaatacggttcggcttgcggttgatgaaaactgtaccgtatacggagatccggaaaagctggcaagagtatttaataacctgctgaaaaatgcgatttattacagttacccggatacccccattgaaatcactgcggaatacggaaccgaccaaatcatcatccttatccgcaatcagggcaaaacgatttccaaacagcagctcacttccatttttgataaattcttccgtctggacgatgcccggaccacaaacacaggcggcgctggactgggacttgctatcgcccgggagattgttaccctgcatggcggctccatcacagcagaaagtgcagaggagctcactacgttccgggtagtgcttcctttatgagcaagcggtttttctggtaagacattttagaaaggcaggatactttatgaaaacgggatcgaacacaaataaggaaagaatgcgggcgcaaagactcaggaaacagcgcaggcgcagacggcgtatccggcgtttgtgcacggtacttatcatacttatgatcgcaggtcttaccgtattcatctccggcaggattcttctggggcaggaaaataaagacattatttccggttataccgcagcctccgaacctgcagaagctgaatctgaatccgaagagccatccctgtcggtggatgtggagaagctctacagtccttattgtatcctggagcagctggacaccggcgaaattctggcatcccggcagaagggcacacggatttatccggcctctctcactaaaatcatgacagccatactcgcgatcgaaaatacgccggatctggatcagacgattccgctgcctgattcccttttctcctccctctatgtccaaaatgcttccatggccggttttcagcccggagaggaagcaagcggcagggatctgctttatggcatcctgctgccctcgggcgcggaatgctgtcttgcttttgccgataacatcgcaggctcggagcgggatttcgtgggaatgatgaaccgcaaggccgatcagctgggcatggaaaacacgcatttctgcaattccaccgggcttcatgatgagaatcactactctacagcagaggatatcgccgtattgcttcgttatgcgttaaataatgaagaattccgaaaagtatttaccgccagccgctacagcacttctcccagcgccttacatcctgacggctttaccttttacagctccatgttccaatatatggaaacggcacagtttcccggcggggaaatcctgggcgggaaaaccggttataccagtgaggccggcctgtgcctggcaagccttgcacggattggagataccgaatacatcctcgttaccgccggagctgccggtgatcatcagacaaagccttatcatatcctggatgctgagtccgtatacagccagatcgggaaccattcggattcccgttaaaaaaagggccgcttccggcagataactgccgggaagcggcccttcctggttacgcgtaagtttttcttttcctaacccggtcttttagatataaggcacgatatttctgatgtttttcattctcttggcaagcagcaggacaacgaaaggtgtcagagcgatcggcactacatccgcaataccaatccagatgacacagtaggtatattccagacctgtgaaataggaaagggaaatgctggtggtcaggatcatcaggataccgaacaggatactccagaacaggctgacagcaatgaatttacccttgttggcagtaagctccagcagatccttctttccattgcgaagatgaatcagggcaggcagggctgcggaaaggcctacggtgataccatctgcaagaggggaatgcagaggaataaagtttccggaaagcagcgcccatacaatagttccgatatatccggcaaagaagccggttacgggtccgaaaagatatccgataactacaataataaatgcaaatgttctgaaatgaaccgcacccgggatcagcgggataggacacagataagcccaaaggacacctgtcagaacaccaaatacaacaaagaaaatgatgttaacaaatgaaaattttttagtcacttttttctcctcctcattcgtggctgattgattaatagctgatttcagctatttcatgtaatatatcaagaagcttcttgcacgcgtaatcaaaaagcttatgacccttttcggctgtggcaaaggtaggggcgccgataacgccgctgtttgtcacatccttcgttttccagcccgcattgatggggccgaatacggttacatatttctctcccttgaagcagtccacgggctcttcatccacagccagctccatatgtacggtttccggcctcgccgcaagcatcagggaagtttccagctcacaggcatggaatacgccgtacttgccggactgctgcagatccttcaggccgtcattccagaacggtgtaaaccaccagtcaaatacaaatacatccaggcccaaatcaatacgcaggtcacggctgatcatgttcagcatatccgtattgccgccatggctgttgaaaagaaccagttttttgaagccgctggctgatatggcggctgcgatgtcatgaagcagggaatagtaggtctgtgttccaaatgtaatggttcctgcaaagcccatatgctcattgctcttccccacattcagctgaggggcaaaaatcagattaccctcttcaaattcacattcatttaccatcttgtccaccagagtggaaagaatgatagcgtccgttcccaccggcagatgtgcgccgtgctgctccgtagcggatgtgggtaaaaggacaatggatttgtccttatccagcgctgcgatttcatctctcgtcaggttttcccattttttaatcatatatcctccgttctgctgcctccggcagcgtgcttttgttgattataaggctgactgccagccgttgtcatacaggaatatagaaatacatacgaagaacaatcgtaatcgcaattgcagctgcattggccgccacaaaccaggcatcgtaagccgtcgcttttatcgccttataggcggtacggcgaacagagaaattcagctgataatagtgcatcgccagggatatcgcctgtcccttgctgataacgcggaacagcagcggcagggaaaaggtcacgtaattcttaaccttggtcgcccatccgcagtcttcaatctcaagccctctggagctctgagcctccataatagcgttcagctccgtaataatcatgggtatgatctggaaaatcaggccgataccgaatgcaagcgcataagaaatcttccacttctgaagccccaatatgatttcactgaagttagtggtcagaagcaccgtataaaaagaggaaatcatcaggaagatacgcagggcgtacacagcgcccttataaagatcataccagtcaaaacagatagaaatgccctgaccgttaaaaaagggcatcactgtttcgaaaaagatagggccgccctgtaccgcgggcgtttcgaaaagtcccagaatcagccacagcagaaaaataaaagcgagaagcactttcaatttaccggccagtacgaggatatacttctgaatccggcaggtacaccacatggcaataaaaaaagcaaacagaaaaagcaaagccactcccgacttgatgacactggtcaggaccgccataaccagaaaaaataaaaatttggttctgggatccagcctgtgcagcagggagtccgcgtctacatactgtaaataatccatttatacattcctttccactatctttgccgcaaactcttccacactgtaacagatttcatccagacccagagccttggaaagcagaactaccggcggcagctggatattgatatggtcaaagatgtcatccctgcgggccagcgactctttggagccctcaaaaatcttttctccctggttcagtatgatggcttcatccaccgttttgaacaccagagggatttcatggctgatcataataacggtttttccttccgcagacagcttcttgatcatatctgccagctcctttatcaagaaaccgtccatacccagggtaggctcatccagaatgatcacatccgcactggaaaacaatacggaaaggatcgtcagcatgtgctttttccccatagacagattcagggggaaggtttcccgatcctcttccagatgataagacttcagcacctccgtcagctgttcttccgaaaaaggcacctgctgcatacgggcacagaaggtaagctccctttccacggtctcctcaaaaagcatatgctccggatgctggaacaccaggatgatattcttggaaacctgggcaaccgtctttttgataatagattcccctttatagcgcacatccccttccgtgggcttgtgcaggccgttcaaatgctttacaaaggtggtttttcctgacccgttctgtcccaaaactgcaaccaccttaccctttgccacattggcgttcacatcgatcagggcatggaagccgtcgctaaaggttttgcccagattatgaacggtaatcaccggctccttttcctcttcctgcacctgcgtattcgtaaattccctgacaggaatcagcttttccagctgcttttgtccttcctccaccgtgtagaaaagctccagctgagggaagcttttggacagttccctatatatttccacttcctggggaatgataactcccagtctctcctgcaatgcaaaatccttgaaaaaatcatccctggtaccgtcaaaaacaacttctccgtccagcaggccgatcacatgatccacaattcccgcagaccataccaggttattatccacaagcaccgttgtatttccgttgatactcagctgtcccaggatactctgcaccattttcttgccgttgggatccagagaactgaccggctcatccatgatgaggatatccggatccatggccagtacggaagcaatacatacggactggcgctgtccgccggaaaggtttgccacacttcggtttctcagatactgaaggttcagcagatccagaacgtactccatacgctccatgatttcttcctggggaagacccaggttttccattccgaaggcaatcgcgtcttccacaccatagccgaacagctggttctccggagactggctcaccacgctgacaaaggttccctccggtacgtcaaagctcccctgaagctccccgtttccgataagcttgggaatgacctggctgaatatctgcaccagagtggattttccgcatccgcttggccccacaatcgccgtaacctttcccttttctatggagaagttcacctttttaaggacttcttttccatcgggagtatatttataactgatatcgttaactacgtaattcacttgattttctcctcaattttccggttcctttccatcggtccgcataccgaagcgtccggttcttccggcaggcctgtactttgccggagatgtcttttatctggatgcggttaccggaaataccgggaaggattccagatagatgatatccttacgcttcgcagcatctccttccgccaatatggcagccttgcccgccaccttaccgccggctttttccaccagggattccatggccttcaaagattctcccgtactgataacatcatccacaatgaggattttctttccccggatcatattgctctcttccctgtccagacagaggatctgttttttctgtgtagtgatggaatatacctccgtcacaaagggatctatcatgtaaggcttgacgctctttcttgcgacaaaatagcgtttcatatccagaatacgcgccatttcctgaataagcggaataccctttgcctcggcagtgatcagataatccacctcaggcactttttttaccagctccgccgccgcctttacaacaagctccgcatctcccaaaaggacaaaactggcaatttccatgctgtcggtgatacggatacgaggcagtcttctgatacagccggcgatattcatctcatagtacttattctccataatgaaccctccatatgatttgttataaaacgcacagtcattttcgacaccttgttttccctgtgctttgtattgttttcctgcctgttacatcgtaagacaacagttactcacaatacaatatcattcaaattatgcaccaaatccgttggcttgtcactaaaaaattaataaatatttaagaattgtttatttatatataactttttccctttacggcatttttgttgttcaactttcattttccttacgtactttacattctgcttacatttccttctacgtataagttgtataaattacttcagaagattatggcaatgcggctgaaaaaagcagaacacatagcagaatgaaaaaaggaggaaacccgaacttatgatttcctcctcctgactatcttttttcctgccgcagcaaaggcagaacctccgccaacactaacaaattgctcgtttcacaccagcagctcccgtcaaacacaccgccgactcctttttcaccttcccagtccgaaagattaacccgttcacagataatccccggaagcagtttccgcggcggactatcccaggaaaaaatcggacgatcttctctcgacatatactgactgatagtcagcgtaatttctttcatcaacgtcaaatatcgttcatcccccgtccaaagatatactttgtacaggctgtctcccgacagtgtacagatcccgggagccgagtgcttattctggacattggcgaagacgcttcccactgttttcattccaagacgtccaaattcgctcccctgcgggaaccggaaattatagctgaccacccagctgctgcagaaatcagccataaaaacggaacgctccagccacttcttctctcctgtagcttcatagagccgtacaaagctctccaacagcccaaacgcgctttcactgtcgggtccctgcaggatttctcccggcccgcccgtagtatatcctctggaagcatctctgtaaaagtacatctcaccgctttcctttgccgtttccagataaatcggatctccgaaaaactcataggcgctgacaagggctgccggcgcaattcctgcactggtcgaacctcccgcggcaattttgcctgtacgtatatttacgaattgaccgaactggccatatttctgccagagagccacgaaccgatcagccagttttcttgtacctgtcaggaattcttccggaatccgctgtccattttcctgaatcagccgaaaatgcttgaacaggaaatacagaacatccgcagatttccggatcagcacccaatcttccgctcctgcatgtccgaaggcatcatttctcagttctccttcttgtgtacacatcccataaaacaacccggaaggtccctgagttctgaacagatgtctcagagtagacatccctctctcccattctttttttccacccagcttcatgagcgcataagatgacattcctccgccaacccagcccggctgccatatctgcgtagcttcttccgtgatgccgactccgtaaaagccacctgattccctgtaattccatgtgttaaatttttctctctgcaattcccactgctcttcaaacgatcctatttccggcagggaatcgtccatttccatacatttcctcgtttcaaaaaatctgcggaaaaacgcttccatgctgccgcagtcccactcataaatacggtatggaatcgttatgctttcccccttatggaaatcccttcccggatccgacttttccttcatgcagaaagctctgtattgtttttcctccctgaaatggggatatcggatttccaaaacaccatccccgcagaaaagtcccagattatatccgtttacctcctgaaccgtataaagaagcaccgcttttctgtatttttttgaaaaaacaccgacacagggcacgcttacatcaccgcttgtaacggaaatactgccgctgccgtcctcattctgccggattacatccgtaatcgttaccggcatatccaccgcagcttcctccggctcaaacatgggcggatattccttttttatagagcgaaaacgatttccgttataacagcatgcgggcagaaatacatattcactgccgtcaatgggaaagtccggctgataccggatccctgcccaggttcccttcacgtcttccaacgcagttatgaccgtgtcaaattcatgaacctcagcgatggacttcccgttcctaatgattccctgtatcatttctttgttcctcccatttttctctatagctgctgggtgttaatccggtattctttttaaaaattttataaaaatgctttgtgctcttataacccaccatagaactgatctcatataccttgatcgtgggatccttaagcagcctgatggcatgctttatccgtacagcagtgagatattccatgaaattactgcccgtatgctgtttaaagaaacggctcagataggccgggttcatgccaacctcgccggatatcgtttccagagttatttctcctgcaaaattcagttcaatataatccttcaatgtctgtatcatattgacataatagctttcttcctcttcttcctgtgtatcatcctttttctcatcaagcgctttttttaatgctgcaaacaatctttccagatctgtataggaagttggcttgagaagatagtcaaatacattgcatcttatggctttctgtgcatagtcaaactctccatacccggttataatgaccaccgcaatatccggtctgtctgcatagatatattcactcagttcaattcctgacagatctcccatccgtatatccgttaataccgcatccactttgtttccctgtctgatatatgcaagggcctgttctgcagaggagaatgatgccgctaattcaaagccgaattcccgataatccataatttcctgaaacagttccctgatataatcctcatcatccacaaatataaaatgatacatttctcccgcccctcatactccagtcatgtacaaaaccaggcaaaaaaactgcctgcattgcttcacagtttctctgcctccattctgtttacataccgcagcctcccgaaagcaaggctgcggtattttttttcagattactttatgaatatttctttccaatttcatatgccttctgatattcctgagtataccactcatttaccttctgcacatccatccctgtcgctttttctatcatttcttctttcagctgattgaattcagcttcatccttcgccataaccatcttccaggaataggttttaaccacatctcccacacggcctgaaatctgttccaaatcatcgggaataggaggaattggtgcaaacggcgctaccgctatcccgtcaactttactcagatattcgatttgatcctccgcaccataatccgcctgccattcatcctccagcttggtatcagccggtgcatccgctgttttttcccaatatttatagccgataggcacgccgtattccttgctcatttcggtttcatacaaaggcaggacattcaggaagttctgggattccggaatgttagagccccccggaaattcctttgtggtatccaattgatactcataaccttccttggtcacgtaaggctttccatcgtctcccacatcccaggttacccctttcggtccattatgcagaagcatagcaccttcttccgagtatataaagtcaacaaaacgcattgccgcttccggatattttgtcgcactgctgacggaaacagaccagttctttccgattggctgaagtccctgatgcagtaccttgatattttctgcttcaaccggcataaatccaattccctgattatgtctctccgtagtatcaaaacctcctgttgcccagccccaccaggagaacagtgtcctgccggctccggccttgcctgtggcatcatcaaaacgctgtgtcatagagtcaggatccagtaaccccatctgattggcatcaaaatacagcttcagagttttcaaataccagctgtcctcatcgaaaatcgtatttatctcatttgtaataacattcagttccagaaagtctccgcagatatcataagaaatcccgtttatattaccgagcagatctcccagagccatccttctgttatcccagtccttccataaagaaaaaccgtataccttctgtttattttcattctccggatagatttcctgcatctttttcagaatgtccagataatcatccgaagtttctacttttggagcgcctatctgtttatagagatcatacctgagataaggtccccagttcagtgttcctttcgtttccagagatgtctggatacgtgttccgactgagaaagcctttccctctccattgctcacattatccgcataatagcggagggagttatctgcattctgatacagattgggaagcagttccttataatcatcataggccagcagcatatgtccggccactgcattgacaacctgtttattgtccttgaatatcacaatatcaggaagttccccgcttgccatcagtgcctgcagtttctgttctccttcatctccgctcggaagtatttccagctgcacaccggccttctccttcaggatatccgcccaccagccctctttcacaccggatgtattggagggcatggaaaagaccttcaatgttacgatgtcttcttccgttctttgttcctgcacggttgtctccgtattgctgctttcctttgtctttgcggcctgaccacagccggcaagactgttcatgagcaggcctgctgccaaaactgttgcaattacttttccaaacctcattttaaatcctcctctttatttagaatccgttttaaccggataccttacaaactcagcccttcactgccccaatcataatcccgctcacaaaataacgctggaatagtgggtatacgaacagaatcggaaggacgactaccatggaaaccgtcattttaattgccgtaggcgtaatcagcagcgacggatccgccgctatcccgttttccatggaactcctcagggaattagcaatggcattcgcttcattgagatactggtacaagataaactgcagagtataatatctggaatcactcattaaaaacagcgtatctgtgaaggaattccactgtcctaccgcggaaaatacagcaatagtggcaacgataggcttacacagcggcatgatgattttcaaaaaaagtaccccgtagccagctccgtccagctgggcggattcttccagggacgcaggaagattttccgcatatgttttaaacagaatcagagaaaacggtgaaataatgccgggaataatataagccagaaaattatttgtaagtcccagattcttcatattaataaaccagggaatgataccggcgttaaaatacatggttataataacaaaacggtaccagaattttctcccccacaattcctgttttcccaacgcatatcccaggaaagcagtgccgaatacattaagcacggtcccaagtacagtccttcccaccgatatcagtgcggaattgcccaatcctttcattttcagaacttccatgtaattggagaaatgaatcccttttggtttccagaggataagtccctgggaaaccagactgttatcgctgattgtattaataaacaaataataaaacggcaggatgcatatcagggtaaacagaccaaaaattgtataatttacaatctgaaaagctgcttcccccgctgttccttttttcttcatgattctcccccttctttatactacactttccccgcgaactaatattgaaaatttattggcaaaaaagagcagacttacactgacaaccgatttcagcatgctgaccgctgttgcataggagtaattcactcccaccataccctgattgtatacatacaaatccagcacttcgatgctctgtttattcatggcattctggaaaacaaaatactgttccattccgttattaatcaggttggcgattgacaaaagaagcagtacaaaatatgtagacatcaggcccggaatggtaatgtagcggattctctgcatccggcttgccccatccaccttggcggcttcatactgctcttcatcgatattggacatacaggctatatacataatcgcattccaacctaatgatttccaggtggaatatcccagcatggtcagccatacatgtttatccgacgccagtacatttattccttcctcaataatccccagattcataagcagccggttaacaaaaccgtcattcacggaaaacatggcataagctaccgaatataccagcacccagctgataaagttaggaattgtcgtcagcgtctgaacacctttccggaaaggtatacatttaatctccgaaaggaaaatagcgaagaacatggggagcggagaagtcagtatacccaaaaaactcatcccgaacgtattcttcattacatgaatcagttcttccagcgcatatttatctgaaaccattcttgtaaaattctgcagtcccacaaactcgcaatccagaagcgcccttccgggtttataatcaaaaaaagcatatatccagccatacaacggcatgtaggaaaaaatgaatactaatagcaataatggcgaaatcatcaggaacagcctgaatcctctttggttaaatagtcctgttttctttttcatctgcccacccctttatttatttttcacagccacctcctatattctatctgtccctctgttttgtgtaaatcccggtacatttacatttggtaccccattttctacccgttgttccggtgctattgttctctgagatactttcccgtatactaaaggaagtgggaacagacaggaggaaccgtttataatgaaagaaaacagtctctttaaattcattaagctctatcggtggagaagtatctttttccggtatcttttcagtttttttcttattattctggctatattcattccctataatattttcatttggacttattacaactatgtcctggaaaaagaaatcacggatcagtccacgaccgttacattaaaatccaaggaaatctttgatttgctgacttcggaattttttgcagattatcggctggcttccaacagttcatccgtacagtcttacttaacgtcagcatctccttccgaagaggttcttttcaactgtaaagatatgctgacctcaatgacctctgattccgatattatagaagaagccttcctgtacgatctgaaaaatggcatggttttgtcctcgcgcaccggccggacttcagaaccggacggatacaactggacctatacctatgcctcgaccaagctttcctttatgatgtttccccgtaaggttcattctcaggatttcaatacactctatatctgcagtgaaatcactgattcccataattctcccatcggtgtattctgcgccagcctggactatacgaattttgtggatattgtcaagagatctttcgaggaagaaccggatcgtattttcatagtaagcgatataggcctgatcctttacagcgattcacctgatttaattaatactatcatgtttgagcatggtgacctgtatgccgccttcaattccgcaaaacaggtagagggaaattccatcttttatgatgataccattatttccgttgctaaaagtacgttttctcatctgctgctaatgtcttataacaaccgcagtaattttatcaaggattttaccaatttaaaaatacttctgcttcttgggggaatttccattttcgtactttcctttttcctttctctctttatttccctgcgtcagtaccattccgtagcggtcatcatggattccctgaatgatccggataagctggctatgaataaaaatgaacggctgagtgaatttttctatatttcccatacaattgcggatatttcccatgagaactcacacatcagctccgaactggatgaaaaggtggcagcgttaaagaaataccagatagcggcacttcaggcccaaatcaatcctcattttctgtttaataccctgcagcttatcaatctgagtattatgaaagaagtaaaaaaggatattgccgctaccagactgatatccctgctttccaatttgctccactactcttatgataccgagcattatacagtcactgtacagcaggaaattgataatgccttgaaatatctggaaatacagcaggtccgttataaggatcacctgcgtattatatcggatatctcagatgagtgcacctccttcgaaactgtaaaactgattctgcagcccttcattgaaaacagtatcatccacgggctgaagggaaaaacggaggaatggcttattgttttccgctgctatcttcgtaatgattccgtggtttatgaaatttccgataatggatgcggaatcccccctgcacagcttgaccgtctgaatacctccatagaaagtctgtgcagtgatacgccggaaagcatcggtatcctgaacatagcccagcggctcagactgatattcggcagtcagtgctctctccggcttgaatccgcctcccgggcaggaactactgtcattctggaacataaagctctgaatgacctctccttctatctggagggaactgcgtcagagaaaaaataacccaaaaaggaaggcagaaaatgcattgtcattttccgccttccggttcacttcttatttcattttgtgtttatccgcacatcaataagtgacttcacatcctgaagaatatcgctgtctgtcacttcaatcatcagccatctgcttccattataaggcggtgcctctgcatacagcttcctcacataaggggtgcaagccgtaagtataagctctgctttatccgccgctttgcttcctatggaaacaaggcaggtgaaaaagcccttatccggatagagtgtgcagattccccggctgcctttcctgtattttacgttccatccgggtttgccggaacagcggctgtattccgttctgctggccgcaccataagtttcttccagataactgagcaaatcatcccagtatggacagttaatatagctgctgatggcctcactgtccggctgacaggaggggccaaaggtttcattccaattcatgtctgtacctcttttctctgtagtcccctccagtatagcaaagatatgtggacaactgtatgtcatatttttctattatctgatgatattaaagcttgccgcacaggtaggcataggcattcagaatcgtgaccggttttttcccgccgatgaaataataatccatctgtgcttctttttccgtatagagataggttccatagaccggtatatcacaggagaaagcgggattttccgtggccagcagaaggccatagcccttatcggaaagaagaaggggcagttctccggtaccgcagtgggatacatatcttgcacagccgcgcagcttcaggccgctgttttcaccggagcccattccgtagaccatttcctccttcggccagtccagatacagccatgttcggtcagcggggccggcacctgtttctatctgacggctttccttactgcgttcggaaagaagcagttttttgtcacgtgtcatataccggatggatccggttgctttatccacccgcaggcaaagttcatccgtggtgagttccaccccgtttcccacctctttgtacatccaggccttttccgttctgtccactgtaataagtctgttggagccttcctgaatctgctgccctttgacaaacgttacacggatgatggagcttcccaccgggctcagccggagtatgccatacctgctctggatataaagaccgtccgccttctttgtgacccacctcacagccagatcaattttgccgtgacctgccgggcgaagcttttccgtacccggcatatctccgaatacgggtcctgcatttcccttttccgtatcggcaggctttttatgactggtacggatccctgccgcctccctgctgtcccacgtaagcgaatcttttttcgaagaagcaggaattatggccggttttccgattcctgacaccccggaagaactttttcctatggaaaatgcggttgtctggcggccgggaaggacagccgcaggcttttttgccgcgggccttgaaaccggcggtgtcgctgaaagacttggatccggttctttccctgctgaggggttacatactatggaaatcctctttttcgtaccggcagcattttccggattccggttcctggtgttccggctgccggagttatccaaaggagttcttttcggcaggggatcggcaatcagccctgtgaggtttccggtatgcagtacatgcagttcgtgaagggcacgggtagcagccacatacagcagcttggcatgtccgtcctccaccggatattcctctctcgtgggatccaggataagtacggtgtcgaattccaggccttttgtatattccacggggagcaccataattcctttgtcaaaaacagccttctccaaatcgctttcctggacggtaatatattttcccatttccccggctgtctttgccgcattctctctgtctctgcataccacggcaatggtatcataaccattttcctgccagcttctgcacactgccgcggcctcccggatcagttcctcatgacctgcggcctgctgtacctgcactttcttcccgtggcggatgatcggctccacgggatagctggaaaactgtccgtgatgcaggatatttgtggcgaaatcggatatttccaccgtattacggtagctttttttcagaatgccaaagctgtctctttctccggaaaggagcaggcttttcagttcctcccagtcattcagtccgtatccgaaatggatgttctgggaaacgtctcccattatcgtataggtgcattcccggatgcagaatttcagcacggaataggccatcattccaaaatcctgagcctcatcaattactatatggtgtgcttcactaatcacctccgtttctttgatcctcttgtaaatataagcaagagcagccaaatcgtacacatcgaattctgtttccggaatatccacctcacagcctttctgctgctggagggtgaggaattcacgatacagatcaaatatggagcgtttccatacctttcctccgtaccttccccggtaggcctttagtatcgctttcctttccgcctccgtatatttcacgccttttcccaggaactcgtcctttaccttaatgaacagtctttcattaagcatatcaattttactctggacggatacggaagggttctgccggatatatcgttccacggcatcccgggacatgagttccacaagctccccggactttgccgtttttccgtctgattcgtcgtaaacgcccgattttccatcccgcaggccctccacaaactggcgtggattcagataaatggattctctgggaataacattccattccagtttgcggcagaaagcctccaattccttaaaccatccgtaggttccccggatacttcccttcttccccactctgtccgttgcccgtatctgatactttttatcatcccagtcttcatacagaagccgtacgaacagctgttccatggtcatctgcctgacgccgtatacatccagatccggcaggactcctgtaatgtagtttaagagaatccggttgcttcccacaatataaaaatcatccggcttaaaccgctcctgataattataaaggatataggaaatacggtgcatggctacggtagtcttcccggatcccgcaactccctggacaatcatgttatgatatggggatttacggataatatcattctgttccttctggatagtggcaataatttctcccagtacggcctgtttgtttttcgccagatatttggtaagaaggtcatcattggtaaccacctcggaatcataataatccagcagtctgccgtcctcaatttcataggtgcgcttcatcctcaagtctatttttcttaagtttccgcccggcgcgggatacgtgcattttcccaagccgttttcataataagcgtttgcaaccggcgccctccagtccaccaccatccagtgtgtggtatcactggaaattcctcccttgccaatataaagggattcctgcttattaagcgccagatcctgaaacactattctgccgaaatagggctttttaagggctttttcatttcgtaccagcgcccgcttcatatgttcgtgcatggtgaccgtattgttcagaatcgttagaacttccacatcgttgtcatggtaatgctccagcatttcatcaatatctgcctgcatcctggccacttcgctgccgtaattcttcacattatcccgaaccaccgccagggtctttgcaagatatgcctcttcctcctgctggaaggccttcgggaccgcattattttcttccggcttcatgttctgctcctttcgtgcgctgttctcggttccacttcctatagaacattttactcaatattgaaaataatactagactttatttttatggtgtgctaaaatatataatgaagtatggataaaaataaaggatgtcttttcgatggaaatgacatcccttttttatgtctttttttatcctgttctctcgttcctgtactgtcaattcagttttctttttatgtagtctatcatatattgctgtcctgcaattcccgcctcgtcctctgccatggtaaagccatgggccgctccgcagaatctctttccggttacctccactcctgcctgcatcagctttttggcatattcctcggcctcgtcacgaagagaatcaagctcacaggttattacgagtgcatcaggaagcccgctcagttcctccggctttgcccaataaggggaacacaggatatttttggcatcctcttcttttctgtagcatgcattaaaaacttccgctatctgagggggaatggcgccctccgtataaaacttctgccctgccggagtaaaaagatccaggggtgggtaatccagtatctgggccaggaaatggaaatcgcctgtttccttcgccataaggcagaccgccgtggaaatattcgcacccgcgctgtgtccgccgataatcatcctgtttacatccacaggatattcctccgggtggccgcacagataggaaaccacatcgtacacatcttccttatccccgggaaacatgacttccggagcaagcctgtattccacattcaccacatggattttcagctgttcatttacccttttacagaacagattatctccttccggaacccctgccacaaaacctccgccgtgtacattgataaaaaccggcgctcctgcttcggcggaatggtaaagaatccgggccctgccatttcttacaggcacaaacctttcttctcctgccgcaggaatactggcatccgcgagtcttttcctgtcatcctcccgcataccttttatgagttccagcagttcttctttctccatctcacattcctctcctttatccaaacctgtaaaaattatatgacaggctgtctctgtcagtcaatgtgaatcagagattttgaggcgggatttaccattatttccagctcttcaatgcctgtggtatgaaaagatataaattctctttttctgattccttccagaaagatattcttacattccatgaaattcctgagatcatctgctatataaaaccagttaagcctgaccgattgtccggattcatattcatccacaaaaggttctaccgcttccgcattgtaggttacccgaaaccgtactgtgttctccggtacttcttcactttccacaatgtcattatcattggtaaagtgaccgtaagttcgttccacattaagaggagtttcctccgtcgcacggaagccgaaatccatatccaccgtctttcgatccatggggcccgcttccttctcacctgcataggtaaaggatgcaaattcatggaaggccatccctgctcccgctccggcaaacaatatgccggcaccaataattattaataaaatgatacgtgtcttatacatttcttacctcccctgtgttctttggtagtgtcaagtctgacactccgtttttattaaaaaccttgtattttcagggattataccgctttttgaaaataaaaaagcaatgacctcccctttttggtataatgtagtcaccacaaccaacataacctaaggatggatcattgctatggataacattatactctatttacttactataattcaagaacaatataatactatctgctgcctcctgaatctcatctgcagatattttcccctcagacagtgggccttcgatgattcccactcccctaagtaccagaagttcaccaccgaccgcctccctctcatcaaaccgttcatcaaacaggattggcaattccttctggagtactatctctggaaatacggcaaaccggtcacacccgttcagcgccgcaatggaaaatccatcccggaagatgtcttctgtccgctttgtggggcacctcaccactacctctacgacaacaatggcggcaacggacagtaccaatgcaaaatctgtggacagacctttgtcaccggcgatgttgtcacctcgcctcttcgctttgcatgcccttactgcggccactccctcgtccccaagaaagaccggaagttcttccgcatccataaatgcgtcaaccccaggtgttccttctaccttcataacctctccaaggttgacaagaacctcctggaggaggattacgacaaaaacaagtataagctgcactacctttaccgggaattcacggtggatttcttccgcatggacttagactccctgcctaagaattcctcctccctgaagttttccaaacataacgcacacatcatgtccctgtgccttaccatgcatgtgaacctccagctttccctccgtaaaacggcacaggctctttatgacctttacggaatcaggatatcacaccagcaggtcgccaattatgccagaactgccgccattgtcattaagccctttgttgaccactacgaatatccaaagtcctccatctttacggcagatgagacttatatcaaggtccggggcatcaaaggctacctctggttcatcatggatgccgcttcccgttccatcctcggctaccaggtttcagacaaccgctccgtcgggccgtgcatccttgccatgcgcatggctttccggggcatgaaaaggctgcccgaaaagttccggtttattgccgacggatatagtgcctatcccctggccgcccagcagttcgcacgggagctgggggacagcttcaagttcgacatcacccaggtaattgggctcacaaacgatgacgcggtctctaaggagttccgcccctacaagcagatgatcgaacggcttaaccgcacatttaaatccacttaccgggtcagctgcggttacgacaattataatggcgccaactataacgtggcactctgggtcgcttactacaacttcctccgtccccataagcacaaccactaccgggtgctcaatccggtcgatatgctggagggtgctgacaacatgcctgggaagtggcagctcctgatcctgctcggccagcagaccattctccatttacaggagcaacaggaagccggcagcatctgttcttagattccgggccggaggtaaaaacgcagccatcccgaagggacctgcccttgatggcacgccaaaacaatgctatcatgctgtgacgcagacggtgaaatcttatctgttcttgagttcttcgccgtcggtaagacgttcagagcattgttttggtgtgccgtcaagggtggcggacactgccagtgtctaaatatatctgcaattttcaaggttcatttatgccgggttccccggctatcggttttcataaatcccttgacactaccccgcttcagcggacattcattcaatatttgaaacgtactttgtttcaaacttctctccctttctcatgacagccagccctcagcccggccagctgccttctgcagatatctgccgtttctttttccatattgggaagccccgaaagagcgtattcctttccgatctgccgccatttgtcttccccgtatccatgatatggcatcagctccgtatccgctatggacagcctgtccgccagctctgcaatcgcctttaaatgctcccgggtatcattgatccccggtatgatgggacagcgcagcactactttttttccatgctccgccagcagctccaggttttcccgtattcttttcaggctgccgcccgtataacggtccatctgttcctgggtatcaagcttgtagtcatacagaaacagatccgtatcagcgagtacctttaagaaagccttttgggatacatccccggcagtctccacacaggtaccgattcccctctctttgcagagtctcagaatttccgccgcaaaatcgggctggagaagcggttccccgccggaaagcgtcacgccgccttcttccccgtaataaggcctgtctttcccgattacctgcagcacctcttctgcagtgcaggcttttccccggatacgcagggcatcccccgggcaggcaagacagcactgtccgcagccggtacatttcccacgatccatcctgtgtttgccgtttatgaagctgtggacctcagacggacagacggatacacagctgccgcagcccacgcactctttttccagatactgcagtacggggcctctctcatggctttccggattatggcaccagatacagcgcagaggacagcctttgaaaaaaatgctggtccgtacccccgggccgtcatggatggaaaacctctccatggaaaaaatttctcctgtcatctcttcctccaaagccgccgtatgccgtcatacatcctgtaatggtttaataacagctgcggctcaaaatatcctcctgcacctcttcagacagttcgacgaaccgtgcggaaaaaccgcctacccgtaccagaagccctgtataatcctgaggacgcttcctggcattttccagatcctcccgtcccactaccgtgaccatcagctgcgcaccgccgcgttcaaaatagctttccatcaccttcaccgccgcagctctggattcattaaaggtttctttggaaaacttaatgttctgcacggcccccgcatggatatccgtatccgcctgcagcatggaattcagcaccgccgtgatcccgttttcatcggcccccgcctgggggctgttggcattcgccatggacacaaaggcatgcctcccgtccgcgccagcgccggtgagaaggcccagcgaagtattcgcgctgttattgatcactacgatcagatagctgtccagccccacccgttttgcctgtgcctttgcggtcagacagacaaacctgtgcagacttttcagcataccgtccgcctcttcctgatcattgccgaacttcggacagcgcttcagccgcttctgaagcagatcatatcccttaaaatccgtctccaatgccgtcaaaagctcgcgccatcccaccagcttctgttcatacaccaacttcctgatggctgtaagactgtccgccgtattcacattaccgtagctttccagcgttccgcccagataacgtatgccgccggagaaaattccctttccccgttccatgcagtcatcataaagcatggaaagataagacaggccgcagacttcccccgcaaaatcatattccatcctttcctgctccgccatcacctctatatgaaaggaaatccattttttataggcttcataaaactgctcaaaggtttcatattcctcagcccaccgggtaattccggcttctctgcgcagcagcgtcagacgcttttctccctcttctccctgcaggtattccgcgtctggttctttctgcaccccgggagtatataaaaacagttccagccccttcatcaggttgatcacgccgcttggcgtaccaaacccggcatggtctatcacatattccccgcagccgtagggtacatagtgtactgccgtttcctccggaagctcaaaggccctgcagacatcccgaaccacggtttcatccctgtacagaacaggataggtgcagccttctccaatagcatcataggccatctgaaggatttcgggatccattcccttgtaaaaacgcagggacagctggggatccggattcttcagctttcttgtggctctgatacaggctttggcaaggcggtccgccttttcctcctgctcccgtcccctgccgccgataaaaatacggccgtcggtaatggtgcgccgttttcccatccgttcccacagcttttgtatgatggcatccgcttcttcctgcgtgagatatccgctgtcaatatcatccgcgtaaaaacggcccagatagctgtcgatccggccataattgcgaacctccgacaccagcacatacatccagaacaattccgccgcttccagcagatgttccggtcttttgctctgaatggacgccatggcttcctgaatcgccttcatccgcaaaaatgcgctccggttctccggcgtatcctcccgctgtccgatcaaatccgccttctgtgccgccctcttttcataaattcccatgatcccgcgcagtgtctccagacacaaaagcattccttcatacacgcctgcctcttcactgccgggcctcgccttactatactttttttccgctgtcgccttaagtcccggcagccccagggaaagcagcttttgaaagtccaggatccctcccgcgatacggtaaagaggatacgttatcgctttttccccttcccagtcatccgtgggcatggcaagaagctgctgcgggctgtagcgctgccgcagccggtgcttgcagtcctcttcctgccagaagcttctcatctgctccagctgccggcaatattccggacgatcccggtttctgtctatttcttcccggatcttattgtcatgtgcatagtacaggaatccgccgatctggctggaaaaaccgactgctccataatggcagcctcccggcaccagatcatcctcatcgatatcaaggatgatccgcggcagctgccaggccaggcatctggcctcccgcactgcccggtggacggcggcattctccctgtatattcttgtaaattccagttccagcgtaaaatcacttctgtccgctattgttgccataaaaagctcccctcacagccaatgtactgtcagcttcggcacttcgctgccgtcataattttcactctccgaaaagcctccggattttttcggtatcagaacaaaagaaaaagtcctctcttctcccgggaacagcaccctgtcattgtcactgcccagcaggtaatattgatttcccacgagggcaatacccgcatccagcacggctctttctccggtgtttatgagcgtggcctttacacactgcctgccgtctctgcgtgtctcccatttttctgatttgagttccgccctgcctgtattcttgaaaagcggggcaaacacttctttttcccgggtgccgaacatatatgtattctccgaaagagtcctgccctcttcttccagatataaggtgacaaaaaataactcttcctccggtactgttccctccgtcattcctgcctgtatgctccggttttccggtatttcagcgctcctgctgtcttcagccaatacttttccggaaaggctcctgaccagtatcctcacttttcccgaaaaggcttccccgctattggaaacaaaaaccggaaggcagatgttttctccctttttataagtaagggtccggtaatccagggatacatgtctttcctcataggctctcttcacctggtaataggctgttttggtttccccgtaataatccaccagattggtacaggaagcattgggccatggttcattgagctgccagatgatggttccgctgttctgccaggctcttctcctgtccgcctccaggataaagcgcagcccttctccctgcatgtactggctgcatcgggtgaaaagcccgaggttttcaggcgtcttttctatagaaccgaacatttcgcaatcccggaagtaggttccccaccattctccgtgatgctgccagcagggatcctgggacatgggtgtcggatggagggaagcccggggcaggaactttttcaggctcttttcacagcttgccgcatccatcccgaattcactgtggaacagattgtcagactccccatacagcacataatgcccgggatttccctcataacgccagctgccgtgaacatcatggctcacccctttttcggaggtgataaattccctggggccggatgccgacgtaggaagaaaagccctgcgcccgtccagcctgcgcacgatttcctccagcatggcaatatttttattttccctcccgcacggcctgtccggcgcttccatcaattcatttccgccgctgtaaaccgccagggaaacgtgatttcttttttcccttaccgcacattccgcggttttcttcaaaagctccagaaactcttcctgttcactcggcttattgtcaatgccggagctggactggatgaattcctgccagatcagaatcccgttttcatcgcagagatcatagaattcctctttttcgatcagtccgccgccccagacacgcaccaggttcacccccgcgttgaccatggcagataccatataggcgtattgttcctttgtcacgtttccatatatatgatccaggggtgtcatgttgacccctttgatatacagcttccgtccgttcacctcaaaggtatagggcagcgcgttttcatgctccttctcgttatgcaccattttcaggctgcggatgcccgtatttctttccgtccgatacagcaccttttcccgtccgtctttttcctccagaagctctatacggatccgatataaatactgagggcccgcgccgttgggataccataaaagcggatcttctaccagaaggacggtatcaaaccgcccatcacaaaggggaaccgtcctgctgacaccgtccctttttccggctgttcttccggctattcttcccgccgttccaacgccctgctctcgtataagctccgcatccccgccgcagcgtgtccccggagcttccgccgtgatcctcacccagagaggcgtctcccggcattctctgtaatccattccctgtccggaaacataaatcctcccggtttcttcacaatagccggtatccagatgcagatccgacagctctgcctgtcccggaacctccagcacgacatccttccagataccgatattcaccagccttgtggaaaaatcccatttatagttaaaccggctcttctgggtaaacgtcctggaggtataaccgatctgccccatttcctgagggattccctttaaaagaaccaccagcttattttcttcccggatccttccggtaagatctatggaaaaaggctcatacatgcccttgtgttctgcacacagctgatcattaaagaaaacggaggcttcataatccactccttcaaaagtcagccttactctctctttcgccagatcacagccgttgaaaactgacggaaaaccggcgcgatacatccaccaccggttttccgcccattcacaatgcaggctgttttttccataataaggattctcgataaggcctgcccggaagaggtcataatgcacccctcccggaacctttgctggaagccagtccgtcaccccatgcagggtctggccggtctccatgcttttctccttttccggcacatacggccagtatccttttacttcccaatgcaatcccgacagtgaaatattcatattgtctcctgcttaaaaatacactttaaaggttttgatttcgtagcatcctatggcaaaggcaatgccgttcccgtttacagccatttccctttcctcttcttcacacagattggtttccgtcacccgctttacggttctgtcaaagaacagtcctgccttgtcatcgctgcagtttttatattcatagagacggatcacacaggactttccgtcttctgccagcttcaccgtatccagaagaatgtgcccgcagtccgtatgtacaaaagaagaccgtacaaagctttctccctgtccggcagccggcacgcactgtgtcagcaccggcatattcagatttatggcagcctttgtcacatcggccgtttccgccgtgcctctgtggggatagagcgaatatgtgaaatggtgcacctttcggtccgctgtctcgtccggccttaccgccgattttaacagggacaggcccagcacgttttcatgcacgtcatagccatacttgcagtcatttaatatcgccacgccataatcaccctgggacagatccgcccatctgtgtcccggcacctcaaagcgcgcaaaatcccattccgtattggtatgagtggggcgcctgatattgccgaactggatttcataggaagcttcgcccgcatggacatccacagggaaatatgcctttaagaaaacctgtttttccttccagtccacggtggtgacaaagtcgatccgcctgtcatcggcatagacaatcatatcctgtgtcaggacggatctgttgaacttccaggaggaacggatcaccgcggtctctccctgggaaaccacctctcttttggtcaggacaaaaggcgaataaggcttctctttataataaacatccacatcccatgcatcaaaacgctggggcttgtcctcaaaagccgcaaatacattcatgggacgtccgcagtccacctgtctttccgcttcccggtcatacaaggtttctatttcgccgttggcattgaaggtgatccggtaaaagggactgatcaccgcatcacagcataccgatacccgtttttccccgggttctgcggcggcctcctgtcccgcgatctgcagggtcttgtatccgaaggccggaagcttctccacataagccagaattccgtcctctcctgccgtttgggaaaccggcccgtcctcatccagaagcacggtatctctctccaccccgccgccgtaagggatgcagacataatcgcttcgctcatatcccgccgtattatacagaacaacgctgttcctgttcacccggattttctcagaaagcttttccttcgcttcctctaaaagcaccgctcctttttcccgaatggcctcatagtcccgggccgtgtcctcatatacctgtctgatggaagagccgggcagaatatcgtggaactggttcagcagaactctttcccatatgctgtccagtgtttccctgggatacaccacaccatccagatgggccagcgccgccagcagctctatattatgaagaagaatctctgttttgcggttatagcgcttcgtttccgcctgagaagtataggttccgcggtgcagctcaaaatagagttccccgtcccattttcccagattttccttatccgcatgatcatacagcctccggaaatatccctctgcagaactcatctccactctggggattcccgggatatttttcatcacacggctctgctccagcatttcccttgtggggccgcctccgccgtcgccccatccgtatgcgataagcagctcatcatttttatccttatccttgtaattttcccatacgcccgtcacctcttccggatccatgtgcccgttataggtgtaaaaccaggaaccatcctccggcgtggtgataaaatgggtgaagatttcggaaccgtcaatccctttccaccagaacgtgtcataagggaaatgattatactgattccaggaaatcttggtagtcatgaaatacttcatgccgctctttttcataatctgcggaaatgcggcggaatagccaaacacatccgggagccagcagagggttgtttcttttccgaattcttccctgataaaacgcttcccataaaggaactgacgcaccagggattccccggaggggatgttggtgtccggctccacccacatgccgcccgtgatttcccagcggccctcccgtatgcgttccttcacctgttcataaatctccggataatcctcttttaaaaactgatacagctgcggggaagaatgcatataccggtactccggatactgcttcatcaggttgagcaccgtggaaaatgtgcgggaggccttttccctggtggcggacagcctccacagccaggccatatcgatatgggaatggcccacgccgtaaaccacaggcttgatttcctccgtccttcccatttcgtccaggcctgcctgcaggaagtccagcgccttataaatggactgataataggtttcttctttgtaattcaaaaaggcaatcttttcgaaggtttggttcaggagctttgtcagccgtattctcctcagatcgttttcatccaggagaagcgcgcacctgcgcactgtgtcggccataaagcagaaccggtccaccctgccgtctatccataacagctgcgccagcttaaaggtgcggaatctgggcggaaccagcacgccgctccaggccttcagcgcgatctgcatttcttttttccggcataaagcttcttccagaagcgcttcctcatgccagatatcgattccctgtacgggtttgccgtcaatatacagcagggtttccgccgtggattcgccgccgtctctgggccctaccaaaagccggactgccagggtctttcctgtcagttcctccggcacctccaccttcgtccggaaccaggccaccctgtcatatccgccccatgtatcccagagcttaaaatcctgccatgcgctgtcatcaaaatcagccgcacaggcagtatccattttctcttccatggaagtctcataatacttccagttttccagatccaccgccgccctgacgcggctcgggcggatatcctcctgaatatatttatcgattttctccagtataaaatgaggatcctttaccttcataccttttctcctatattgtcagatttccggccacggacagcgccgcataatctcccagctgctcgcccagcccggcgggcaccaccctgcaggactgccgggtctgcgccagcgcttcctcggctatcacctcttccatggggccccggaggatttcctcctggcgcaggaaaatactgccgatcacaaccacttccggattcaggatatccgccagcatggcgactccccttcccagcattcttccggtatattctaaaatggaaagggccaggggatccttctcctgcgccgcaaggcctatatcccgggtggtcacttcttctatggactgcccgcgctttaaaatcagcgtttcttttccctggccgcaccattccgctaccttttccctgccatatctggcaatgcctccgccgctgcagaagccttcgaaggaacccctctttccatagccctccggcccgtcttccagaaggcggacatgccccacctcaccggccatgtcgttggttccggtgtagagccttccgtctaaaataaggcctgcgccgatacccgttccgaaggtgaggaaaaccatattacgggttcccctgccggctccccagaaccactccgccagcgcacaggcattggcatcgttctgtaccgccgcaggcacatgaaaggcttcctcaaaaggagttaccacatcaatgccgtcccagtccggcagattgggcgggcaaaggatcagcccctttctggaatccagagggccgccacagctgatccccacagccgtgagctttacttccggatgtgccgagagcatatgtttcaaagtctccaccatcttatccaccgctgcctgcgggcctttcggcgtcggaaatttttccttccataaaagttccacctgatcgtcctgtattttaccgatagtcacggcgcatttcgtaccgcctatatcaattcctgcaagatattccatcctgaaaatgcctcccctattttgtactgtcacagagattttatgacacctctaaaattccagcagattgacttcctgtatcgggcagctgtgatcatagggaagcttcacggtcttaatctcgcagggcgtaaagatgagctcttcctccctgtttaaaaacggtaccttcagcaccgcccttccggcctgcttcttcgtctcgtatgcacggacgatcacgccgtctttgtcctccgcctctttcaccgcacagatcaccgcatgatcgctttccagtgacaggaaggaaccgcgctgggcgagctttccttcatggaaggtctcgatgaccgtctgaggccttacgtttacttcctttgcccgcctcaccacatcggcatccttccaggaaccctcgtgaggtatcaggatataggtgaactcctgaagaccgtcatccacaaaacgatattcacagtcttcctccagctgcttgggatcatgatgggcaaaaaccgaatttttcagcactgtcagattcatttcatcaatatccatgttgtagctgtatttggcgtcattggctattgccagcccgtacatcaccggcttcttaaaatgctctcccgtaaaatcaaaccagctctgtccgggctcttcttcgccgttggcgctcttttcaatatagccgtaaggtatttcatatgtgggcctgcggaaattgaagttcaccggatacttgattttcagctgtgtctgaggctcgcgccagtccacactgaccttgacctggacataatccagatcacggtagagccggaaatcctgtaccacataggactggttatacttatatttgatcctgatgcaagagcgcaccggcccttcctccagaacctttctatatacctgcttcatatcgcccagctgcctgtcaaacttgaaaacgttgtgtgcccaggtatcgtatttatcctcgatcacggcaagccgcccgccctgtctgcgcagtacttccaaatccgcctttttgtcgtaaaggctttccatatatccggtctgcgggttaaacgtaagcgccagacggtcattttccagtgtggtatccgtcaccttcacagcggcagtccggggcgcatcctccacgttcaggtacagcttgaaaacctcataccccatggaaggcagctctgccacaaaaagaaggcgggactgcccgttcaccgtcgcctccgactgaatcctctgggccgcgatcccatttccttcgtgatccgtcaatttaaaattatcgttggaaaggccgcgcacctccagatcgatgatcatttttccttcccatgcgtgggaattgaataccacgatcgggcgcatggtcacatcttcctcaatatcaatatcccaggagatcgcctgaatggcgtagttcaggttttcctgtcccaccgccatcgcctgtccgaacagataagaagcatcctcataggcggaagggatgcttgttccggccagaatatcatgaaactgattaaataaaacacccttccaggccttcttaaagtcttccggataaggctgtccttccacggctttggcgatgctgctccagccctcggcctccatcagcttatcctccgccctgcggttttcccttttcacgcgggaaagcacactgtagcagccgctggcatgatgctgcagatccccgatgaattccggatattcctttccgttgtttttcacctgacggaagaaattctccgtggtttccatttccattaccggcatatcttccctgccgttcagctcatgaatgcttctgatgttctccttcgtagggcccccgccatggttccccacgccgtaaaacatcatgagctcgtcctcaccgtcctccagctcacatttcaggcgatccgtatacttctccagatccttgccccagctgcagtattcatagggaatccggtaggtcatgaccttggagccgtccatggacttccaccagaaaatccgtcccggcagccctttttccagaggcatcggccgcatgaacacataattgtccataccgcttttcttcagaatctgcggcagattgccgttgtgcccaaagctgtccacgttgtagccggtcaccgccatttttccgaacttctccagaaaataacgctgtccatacagcccctggcgcacaaaggcttccccggacgggatgttgcagtccggctgtatccaccagccgcctgccagctcccagcgcccttcctccactctttttctgatctctgcgaacatggccggattgtttttctccacccattcataaaaagcggcgctgctgcaggtaaaaacaaaatccttgtcttccttcatacggtcaagcgctgagcggaaggtggccttcacttcctgaaagccttcctgccagttccacagccagacaggatccagatgtgcatttccgatcatgtacagttttttatccttcatctctccgtctcctcaagccctgttttcactcagcaggtaattcctgatcttatcttctaccagcagccttaccgcttcccgggatttttcgatctgctccgccgtgcaggcattcagctcttcctctgtcatatggccttccctgccaatcaccgccagcatggcaagctctatgtccgttgcaatattcaccttactcacgccgcctgtgggaatctgcgccgccttcaccaccatttcgctgggcactccggatccgccgtgcaggacaagaggggtgtcggtcagcctgttaatggcctccagacgctcataatccaccttgggctgacgtaccgtatatacgccgtgtgcggtccctacggaaaccgccagacagtccacgccggtaagcctgcagaattccgccgcttcctccggattggtatacagctcttcatccgtatccgtctccgcgaagtccgtggtgccgatttttcccagctccgcctccaccgtggcatgataaggctttgccatctccacaacctgctgtgtgacagccacattttcatcaaaatccttttcagacgcatcgatcatgacggaagtaaaaccggcttccagcgcctcttttattacatccaatgtcttcgtatgatccagatgcagcgaaagggggatctgaggatccagctcctccgccacacggtaaaattcatccgcaaattcctttatgcccactttatgacggatcacttctttttccgacagctgtacaatcacaggagaattggtgttgatcgccgcctggataatggggcggattaattttgtatatcttgcagagaaagaaccaactgcatatcctttctctcttgcatctgctaaaagttttgtcaggttctgtatatcagccatttctttttctccattctgtatatggtcactctttttcatcattttaccgccccgcctacattcatgccttcaataaagtaattctggaagcagaagaacaacagaaggatcggcagcatggaaaggaaggagaccgccatcagatagttccattccgtaaagccctgccccttgaaaacctgcaggcccagctgaagggtgtatttcgccctgtcgctcaaataaagcagggggccctggaaatcactccacgcgcctttaaaggaaatcagcgccaccgtagccagaaccggctttacaagaggcatcatcagcctgccccagatgtaaaaatgacccgctccgtccactcttgccgcctccatcagttcattgggaatggtcctgtagaactggcgcatcatgaaaatatggaaggcatttccgcagaaggccggaacgatcaacggcagataggtgttgacccactgcagtttggaaaaaataacgtaagtgggaaccaatgttacaaatccgggaatcatcatggtggccagaatcacgttgaacagaaatttcttccctgcaaaatcgatcttcgcaaacccgtaagccacaaaggagttcacaaggacattgccgatgatggtaaaaaacacaatgatcagcgtattgatggtatacctggtaaaaggcgccttgctccaggcaatggcaaaattttcaaacatgggcttctcaggaagaagcttggggggatacatggcaatctcaggcgccgactttaatgccgtactcagcatccacgcgatgggaaacaggatgagaaccgctcccagcgaaaggataacaaaaagcaggatattggtgattcttcgttttactgatttagtcattgctttctccctcctcatagtaaacccatttattggagattttctggtttatcacagtcagtatcatgacaacggcaaacaggaaccagcacatcgcattggcatagccggttttaaagttcttgaaggcctggttccacagatgcaggttataaaacagcagggaacccgccggttttcccgttccgtctccggaaaaaatatatccttcctggaaaatctggaatgctccgatgatgccgattgtcaggttgtaaaaaataatcggggaaagaagcggaaccgtaattttggtaaatttcttaaatccactggcgccgtcaaggcttgcggcttcataataatcctggggaatactctgaagccttgccagatataaaagcatttgtcccccaagcccccacaaatgcatgagtataatggcgggttttgtccagttgggatccgtcagccatgcaggccctttaatgccgatcagggcaagcgcggagtttacaaggccgttggcaggatccagaagcagcatccataagaagtaggttcccacgccaaccatgatggagggcaggtagtagatcgtccggaatgtcctcaatccgaaaatggacttgttcagaataaccgccacaatgacaccgcccgcggttatcagcggaatattcagcagcgcatagtataatgtattttttaacgctttccagaaaagctgatcctggaaaaacatttttttatagtttgccagccctgtaaaatccatcttcagcatattgtaattggtgaagctggtaatcagggagaaaatcataggtcccagagtgaaacacaaaataccaatcagccacggcaggataaaaatatagccgtatgcattttctttcccttttctcgttttaatgccaagtttgtcaagtaccttaccaaacataccgcatccccttctttctttataaagaaaggctctttacttgtcagtaagagcctttcccttcagtagttcttatacttccggccgaaaagcccgataaagccagactgccagattattatttaattatcttccctttaattgcttgccttgaaatcttcaaatgccttctgggcattatccagtgccgcatccgtagattttattccgagtgttccctcttctacaagcggatttaccacatcctggtagcctttgatttcattaggggtaataactgtggaagtctgctccagggcctcagcaatctcagccacatgaggttttttgaaaaattccgtattctcatcaaagtcatttcttgcagagaaatctccaaggcttgagcacaggaaatcctgcgtatcatagctggtcacaaatttaatgaattcataggatccttccggacatttggctcctttggggatttccaggacaaagccgccgccgtttaccgtattgccgttgccttccttaaattcaggaagcagcatgattccataatcaagatccggcgctgtctgtgccagggaagaagtatatgcggaggtctgtaccagcatggacatcgcgcctgaagcaaaaggatctgtcatgccggagctgaaggctgcggagaactcatcgtatgtactctgtccataatattcaatccagcttcttacccatgcaaaagcttctttattcacatcgctgtttacagtaggctctcccgtctccggatcaaaccagcagggtttcttgtttgcattaatcagccatgtatcaacgccgccgtttccaagcgtaggcataaaaccgattctggagtacctgtctccgtcttttacatcaagcttatgagccgcttcttccagatcagcccaggttttgatttcatccgcattaatgccggcttcttcaaactgagctttgttatagtagataacgcgagtgtctaccgaaagaggcagtgcgtatacggagccgtcatcgcctgtgcaggcatccatatactgttcgtagaaagcgttcttcacatcgtccgtaagataagcatcaatgggttccgcctggccttcctgtgcacggaacttcacttcttccatgctgtttgccatgatgtcacagggctttcccgctgcgatctgcgcgatgtttttggtgaagatatcaccccagggaatatcaacatatgtaacatggtatttgctctgcgaatcgttgaaatcctgtaccatctgttccacataaggctttctcgcatcagagctccaccatgcccagaattccagttccacaacttcaccgttatcttcagccgccgcctgtgcatcagagctctgctctgttcctgccgctgcacctgctgtgctttctgctgccggtttggtgctgctgtctttagcgccgcatcctgtcagggccgtcatcaccattgccgctgccaaaaggcctgccaacattttctttttcatgctcccatttcctccttatttatcttgttttttcatcagcatgtttgctttgtgtcattatactatcatatatattcatcttttgcaacctataattgaatatattttgaatatttttgatataaaattgaatttattttgcacagcaatagataaatcatctcgtttaagtgataataaataaattactcctctcatttttagttattttgcacaattaataactattttactttctttatcaagtaatttatcaatcttcctggctcacattatatcttttttcatttttcaaattcgttcattatcttttcatcattccttcaaaatcttccacatttcattctgacgtccggacaactttttttccatgtgatctcatttatatttttacatgctatttcatatctttttatggcgttctttatgctctgcccctgctggtaatcacgtactctacttctttctttttcattagatttcatattttttcacatttttatgaaaaaatattcattttttgctcgtcacgtgctataatgcacttgtataatgacagttcacttttttgaacagaaatgaggtaaagcaaatgattcccgctgtacgtcaggaaaaaattctggaaatcttatccaacaacgaaatagtaaccgtggaatctctcatgaacgagctgcaggtatctgtctccacgctgcgcagagatctgattaagctggaaggggagaaaaagataaccctgcttcacggaggaggcgtacgcctggctccgaaaacagtggagctcaatattttcaccaagcttgaaatgaataaggacgccaaagaacgtattgccagaaaagcggcagggctggtagaggacggcgatactatttttctggatccgtccagcaccacatacttaatgataccctttcttgccgggaaggatatcaccgtcctcaccaatgggatttcccatatcaaccagctggttgcgcttgatatcccatgtatcatggtgggcggttccatcaaaaaaaccaccaactcctgcatcggccctatcacggaaaccaccctgcgaaccttatatttcagcaagtgctttctgggcgccaatggtttttccataacatccggcattacaaaccacgatatcaacgagcgtgttatcaagcttctggccctgaacaattcctgtcagccttattttttaatcgatcataccaaatacgggattgtgaccatggtccagatagccaatctggatcagtaccctatcctgatcgatgagattccggaggatcttgagaactataaaaatttcattctctgcgaataaaaattggcagggctgttttcccaaaacgggagcatgccctgccttttcttatcttatcggttcttttcagaaaataaatttatagcatttcttaccgtccataaacaatacgatattgttttcccttttccaaacaggactattcatttcctaagaagtcaagataatacatgaactatttttttcggcaaagatactacattgagcaggtgcagcattccttttataatagtagtagagccatactctacagttgcccctgcccctgcgcctgatttgcttccggcccttcgagctgcccgtctccccgcctgcctgcccggctatacaggggatcctgtaaggggcgtataaactcgccggtccttaggctgcgtcctgtgcagccttagtaccgctgcgtgtttatccgagcgagagcgtcccctctaaggtcccctgtatagccgggcaggcaggcggggagacgggcagcacgaagggccggaagcaaatcaggcgcaggggccggggccggcggaggtgttggtactaatactatatttatatcaggagggttactgtattatggaactgcaatttgataattatatcctttcctatgaagatggagggattgaagtaagaaaaaacgggacattgctttattttaacaggcgtcctatgtttgttactgttaaaacttcatttgccgtgagcgagttttttgatgctgcttatgaaaaggcggaaatgcgggacgggcggatggttgcggagggaactctgcgtgtgccttccggttccggttttgcttttattgatacctatgaagcaggggatgccgggtttcggcttcagcgttgtgtaaaggttgtgaaagccggggatgatcttgggttttccagtaaattttctcttgttatggcggagtcggcggatcctcatgattatcagtgttttgcaccgggtgtgtggtaccggcagaatgaattcgggcctgatgagctgatggggaaggatttggactgtgagtatttctggatgctggagacgagatgtgcgcttccgctgtttgccatgcatcatattggttccggggaaatggcctccctgtccaggtgggcttctgatgtgactatgcgcactcttggccttgaacagtcggaaaataatacggatccgaagtttactattggttctgtgggaatgagcaggccggaaaaacgcactctcaactatatgtattatggatttgccgtaaggaaggataatcccactccggttgacggcctgtccatcgattacgtctatccgggctgcgatggccagactcctgtaaagaattcttacggcgggctggattaccacaataaggccatgaatttccgccgcatcaaccatcctgttgtacctggttttgagcagaattattccgttgccattaacttcggacagcatgaaagctttcaggaaatgatgagggatatctggcggatcacttacagccgtatgcgggacaggctcttctgtgtggataatgaacggcattaccgcaactgtatggaaatctttatgaagtacacaagaaaatatggtgactcctatggcctgccctttgcctgccagcttcctgatatggatatttcttccgtatcctttcagttcggttttgtgggacagcagccgggaatcggcaatctgctgctccggtatggcgatcaggaaaagcttccggaggccagggaaaagggaatggggatcctggacttctgggtaaatacggccatgactccgtccgggcttcctcaaatgtgctacaatcccaacataaagggctttgaaccctatccccattatacgcgtatgcttgcggacgggatggaggccatactggatgcttatgtttatctgcataaaacaggggaagaaaagacagactggcttgctttctgtataaaaaccggggactggcttgtaaaagtccagaatgaggacggcagcttttaccgggcttattataccgacggttccatacgtatggattccaagtccaacacgcccagcgtcatccgttttctggtacagctttatttggtaacaggtaatgagagatataaagcagcggcagaaaaggccggaaactggtcctttgacaacgcttatctgaatatggagtatcggggaggcacctgtgacaacacggatatccaggataaagaagcaggaatctatgctttgttcggctttctgtcactctatgacctcgcaggagacaaacactggctggaaggcgcagtgggcgctgcggattatacggaaacctggacttatgcctggaccttccctgtttatacgccatggccgaagcatcctttcaaccagtattccatcagcggacagagtatcatcaccataggcgggggagccgatgtgtatatggccgcctgttcttatacctattacaggctttatcttctgacaggggacagccattatctggattttgcagaatttatacataagaatacacgtcagtccaatgacattgacggaacctccggttatgtcatgcccggcctcggacacgaaagcggcaatttcttcagccagaaattaggaagccagtatcattggctgccttggtgtacctttgtggaagcagagccctgtgaacggctttatgaaacttttggcgtatatgaaatcgaagacgcacagaggatggataaggaggaaagggagaaacggaaccgggtttatgagaattatatttaaaaatgcagttgtagcgtaagtgctgtctgtttttctatataaaattgccccgaatataggccgcagaaattatgcggatcattcggggcaataatattggtgatattcctttacagcatcttattcagctttttatcaaaactcgcaacttcatcacctaatactctgtgcctggcaatcaggatacagtccacaaaatcaagggatgtttcagaaaaaagaaataacgcttccttaacaacattctggttttccactatcacatcatccagaaattctacaagtacacctgcaatctcatgccgttctattttgtatacacctttcagtacatatactacttctgcaataacctccggaagcgtgaaagcaccattctctataatccgtctggcgtcctctgacatctgctgatgatctctcaaaagatatcttaagataacattcgcatcaatcagctttctcatacttttctaccatcgccttttcatatgcgccttcttcctctgccacaagtttagcatccgcatattcggacaggcgtccataagtactgtccctatttgccgtaacaacaaacggcatcccgttctcccgaacactctgccttgcaaagattcgtaccgcctctgcaaaagaagttcccatatcacgatataatgcttctaccttgtcttttaattctgcatccatacgaacctgtaaagttgcctctttcgccataatatcgcctccttgtaatacaaacgtactacattctttttctcttgtcaatattatatctcatattctgaattttattagttacagttcagcaatatgattttccaatattcactggtggcgataccggctattttttcttaccaatccaaagcacattcaccgaatatcccggcgccctgtaaataaattgctccgccgctccggaaagaagccgttcctcatcatgcacccgctccggttcctcaaagctgttttccgcctgcttctccccggtaagtaccacagccttgtaatccgtttccaccgcacagtccagagagatttccacttcatcctcttccggtgaaaaattcacgatttttacaatcacctccgttgaagaatcactgaccgcgcaagccattgccgggaagctgggaaccgccgcttcatggatacattctccattcacataaagcttcatgcttttcccgtcagcctcataccggaaccggttgaactgtccgtattgaagctgcagcaaacgttcttcatccagatatttttcctccggataagcctgttcccggaaggaactgataccattttccagcctccatacaaaaggcttcacattcgccgcattccattcttttggaggatgggtttcgtccgccacatatacctctttcggcatgcggctgctgtatatgccaagactgatttcctttccttcctcagcatagatctcaatatcaaaagctccgcttgtgacttcttcttctccaaatacggcaaataccctttccggatccactccgtaaagcttttgggcttcttcacgctgttcctgatccggcggaaggatacggaaaacaccgtctttttcctcgattctccccatcagttcatggctgatcccaacaggacggccattccatgacgcatttttgtaccgaagcccggacggccccatgagtgaagccattccttttaccggacggtacaaaatcccggtttcctcctctgcctccaccacgttttcaccgcggctgttcccaaacattttccagacataataggtaggaatcgccatgctttccctgttattaaaacgaatcaggttcggaaaccatgcattataatttacattttccagaagaggggcataggaagccagctccaccacatcctggttgcgttccattcctatcaggaaagccgcttcccccagcgcgccatacagctgtcccacccatccgcggaccactgccagctctcccaggaaaatacccgggccttttctgtcatagccgtcgtaataatggatgttttcagcaaaaaattcggcggtactgtaaaaatgctcatccacgatatccgcgggaattccctgcttctccaggtgtgtattggcaatcaggcggatgttgggatatctggctcttatggtatcaaagaatttccgataccgcatttcataatcaggtccgaagttttcatttccgatttcgatataattcatccggaacggctccggatgtcccatttgggcccgcaggcttccccataccgtgtctttgccgcccacagcatattctatggcatccagtgtatcctgcagcatatcctccagttcttctccttcaaacagcacaggcgctcttccctggcaggtcatgccgcagttgcacacatacaggggttccatgtcaagatcctcgcaaagctgcagatattcatgaaatcccaggccgttatagctgcggtaatgccacatcagctgatggccgggacgttcccataccggccctattacatttctgaaccgcatggctgtttccggggaaaagccttccacaatacagccgcccgggaaccgcaggaaccgtgggttcagggccttcagtttttccgccagatccttcctcagtccatgccccatatacgtgtcctgcggcatcagggaacagaagccaaggcttatttcaccgccctccgggcagcagatggagagtctggcattatcgccgtccctgtctgccgcaaagctgccgtcatagcgcacataccctgtaccctccagcaggaaatccatactgccgaacacatgggaatcatcctcagcgcagactcttacgctgaccggatgttctgttttcgcaaacatataaaaagaataggtttctccggctttcagggaaatcccgttaaagcctgtattatatagttttccgcccttttcaaaaacagcggaaagggcggcctgcctgtgtttgttcagggtatcctcccgttccaggcgcatcaccgcctgccgggtataccaggcagggacaggggtatagggcgtctgattctttctgatccatcgggaaagcccttccccgtgattaaactcatctctccagcccgccctggtgaccagcgcatagccgtcctgctccgtatggcagtcctttggccaggtggaatcttcaaaggatctgtttctgagcatctcaggatataagccgccatcacccgctctgttgatatcttcgaagaaaataccatacagattcggggcgacagggaattttttattttgtgtacgtatcgttattctgctcatagtaatccgcctttgccaatattcacttattttccgaccgctctcttatagcaatagcctctatcccctccggccttcaccgggaatacctcaaaataaaccactccgttttcccgcaccgtaatgcagacatcggccattccgtcttccagttcctttctctgtgcttccacaagaggcctcgccccttccttcagcagcttcttctgttctccggaaaggctggaaggctcgcccatggcatgccagagcttcagcgggttgcaggtcacttcatccactgtctttgtgagaatacagcattcccctttttccccggaaggaatcccttccatgggaagacggaaactgcggcagatatcctctccggtaccgtccattgtcatattccatacaatccctctgtagctgccgtcttcttttctcacaataaccgcttcatccgtacggtgcacacaggttccctgcagatcggcaaaaaacttaaaggtccagaaggtaggtttggggatgccgccgtttgccacaagcccgaagcctccgtggaagggtgtaaaaggaacgccctgttcctcgaaaatatcaccgaaggtccagtaggaataggattcgttcatatctcccagccgtgacagctgccctgcgatataagccgcgttctgattggtatcatgcagcgggcaattgggaatataggaagtattgaattccgtaatatggagttccatccccttaaattcctcaaagctgtcgataatatccctggtcgtctgaaggttggcatatccttcttccggctcccgcagcttcacataaccatagtggcccacattctccggcacctctgttgtatagtgatggcgggtcacgaaatccacaggtatgctttctttccggcagaattccaggaagcagcggatccacttttcatcctccacgccgcagatggcggggccgcccacacggaagcgtccatccacttccttaatcgccgcaaaggtcagggcaaacagcttaaagtattcctccatatccgcatccttccagaagccgggaagattaggctcgttccatacctctatcggccattgcaccacttcctgttccccgtagcgttccatcagatggcgcagagtcgcctgtaccagcgcgcaccaggcatcgtagttttccggaggcgtcacattccccttccagtagaataccgtctgtttcccggaagccatcttgtccggcatgaagcccagctccagaaaagggcgtatattcaggctcagatagctgtccatcaccagatccagataggtaaaattatattccgcatgctttattccgttttcatccgtgtactcctgataaatagccatatcatccgaaaacaggccgtggccgcggatgtgggaaaatccgatctcctcctgtacgagagccagctgctcctgatactccttctgcagggcaagccccatgcggcctgttcctatgcagtaggccacattattatggaacggtatttttgcatcttttttaacagtatactttttttcctgtatcatacgattctccttttctttaacaaacctgtttatatcagccccgaccagataatattgcttacattccacagcccatccgcataccactctccgggacggaacggaacaaaccatgccgcggccagctgctccgccggatcaatcaccagagaacaggagcctgccccttcatgcatataggtgccttttgaataaagaaaacctggcccttctcttctgtcaaaacctatcccatatttcctgtccggttcctctgcaccccagcagtaatccggagtatgggcaagaacagaagaagtcatcttttccaccgtttttcttcccagaatcctttttccgtcaagctgtcccattccgagcatcatatttgcgaaacggatcaaatctcccggtgtggaaaaaagcccgcctcccgtattgggaatgtaatccctccaggacgataaacattgtttttccccttttaccgcactttttatatcttctttatcctcttcgtcagtcacatggattcttttcagtctctccgaatccgccggcagaaagaaagtgtccttcattcccaacggagaaaggatattatcatgaatgtatttttccgccattactccgctgattttttctatcactgcccccagcacaacaaaaccataactgcaatactgccattcttctcccggttttcttctcatgccgcaggacatagaaggcgtaagccagtcaaattcttctcccggcttccattcttttgccgcttcctccatatatctccataccggggcaaaatagggattcggaaaacatcccgcatccggctgaagccccgaagtatgggtcagcaaatgaaacagattaatcccgtcgaacggcttactggcaaactggggcagaatatcccccaccttcacatcaagcctggtataaccatcctccaccagcttcatcaacgctgctgccgtaaaggttttggtaatggatgcgattccatgtatcgtatccggccgcatggaatcatcatgatcataataatgggccagccccagccccttttctgcaatcactttcccgttttttgaaatacagtaggcagcgccctctatttcccttctttccatcatccggccaaaatgctcatctaaagcaaggatacgtccggaatgataaccggcttcttccggcagacattctgttttcccttctgtgatatgcaagcttatccccccttcttactgtctgttccatttgtgcttcagcacacctccacatccatttccacatgcgcaaggccgggatccagatcccgttctgcagacatatcaaaaaccggctcgccgtttatgtcaaaatgcacccgcctgatgccatcacaacggagagtactgtccggtgatgtttccgcatggtatgcaatcatcagattcccttcggagtccgtaaaaaaggaattatggccgggaccgtattctccctctacggaataaaaggacaaaaccggagtgccacgtttgtgccatgccgatttatccagcagatcggctccgtcttccgccgtaagcagtcccagcacatatgtgtaaccgttggccgcgcctccggaataggtcagatagattctgccgttggccgtaaaagcataaggcccttcgttgttaatggtatggctcacattctcccagccataaagagggcgggtgagcaggacgggatcgctggtaagctgccagggttgtgcttcatccacccgggcaatatacagcatggagcctgaatcatattcggtaccgattccccttcggtaggaccagaccacataggaacagtctcccgatttcaggtaggtcatgtccagcgtgataccgtcctgcgccagccagcttccgtcctttctccggatccggatcggatcctcccagctgcccgcatccgtcaggctgccgccttttttcagcttcatgaggtggcactgcggcccccattgtgtgccgcttaccgcaaacagtatgtaaagttctccgccaatcacatggaattccggcgcccagaaggtctgtaccagcccccgttcttcatccaaatcgagaatcaggtgctgcttagcatcctctttaaaaaggtcagccacagtcccggcttccctcacatagaagcccacatcattcaggttgtcattcgttgatatataatagtaccggccttcccacgggaaaaccaccggatccccgaatccgcaggcaaggggaaaggcatactgctcatttattacagttccggcaatccggcaggttcccttcctgccgaaatcaattttcctcacatcccagcggacacgtttctgtgcggtagaaccatccgaatacacaacggtcgcctttatcttttccacagcttccgcatcatgtgccggtatcttatccggcacatgtacggcaacggaagaaagcctgctccagtgaagggccgccctgtcacacaggctgcggcttacctccaccgtatttcccgcccgggcgccttccggcagctgtccgggatctgcaaaccccatttccctgaacgcaatgaaatcatccgtggtccacagcagaagccttccttcacactcttcatccgcacttccgttttcattcacacgggaagccgtaattccaaaacctcccccaggcatggggaaaaccctgggttccttcacccctttagggcatatggtatcctttttatccaatgtcccctccacaaacagaataccgtagtttccattcatggcctcataattctctccatccctgctgtatgccaggtgaatgctgcgcgccagcccgtccggatataacctctcatccgtttttcttgtgtataccataatcctggcgcttttctccgcaaaatctactcccatgccgattctttcctttccgtcctctttcctctcagtctcgtgctgtaacatccatcaaaaacgccgtcacttcgtcttccggcttcacctgtgccctggggctgtcaaaaaaggtcatcacagcaggcttctcttccagaaaagcatcccatttttccataggagtcccgtccgcgtccgcgccgttaggatctcccttttttataaactccgcccagtaattgcacatctgccgggcgaggtcataatgctttccggtaaaaggcctccagcatttcgccagggtttcaaagaagaaccataaatccgaagaatggaaggctcccggattgtcttcccccggtatctcagggccgaattcgtatacataacagggctgcttggcccctgccttttccagcaggctgcacatcctgcggatccccagctccacggagctgacaaggccgttttctttggctgcttccagtccgttctctgcatggatcaaatccagatattcctgggcacggtctccgaatttttcttccgcttcctttttcagggcatccggatcctccgcctggggcgccgtgaaaaattcgttgttggtgaagccagtcatgatcggcacatccagcaattttcccgctttcatattgttccagtaggtatcggtctggtatacgccgtccgggatggttccccagaacgcgccgaaggcattgtttttatcacggatgaattctgcgggaagcgccctggcttcttccagtgtttccacgccgaggaaagcaaaaaagcgttttccctgctccagtaattcttctttcgtgaaccgcatacggtcctggaagggatcaaagaaaatcccgctctcaacaatagccttctgaatatagccctgatttccctgacagttcagctgggccagcacgctgccgccccctgccgactgtcctcctatggtgatattgtccggatcgcctccgaaagctgcgatattgcgttttgtccagaaaaggccgtactgctgatccaggttgccgaagttcgccggagcttccgggttttcctcccacagctgagggtgggtgaggaagccgaatacgttcagccggtaatttaccgtcaccaccacgattcccctgcgtgccagccgttccccgtcaaattccatttccgcaggattgccccactggaggccgccgccgaaataccatacataaacgggaagcttatcctctgtgctcactgcaggcgtccatacattcaggtacaggcagtcctcgttcatggggatggagggatccacattccattctcttgtatagatgttcgtttcatccagtcccggtatgctctgcatggaaatgggcgcaaactccaggcagtccctgacgccgtcccagtccactgcgggctggggcgctctccagcgcaaatcacccgtcggaggtgcggcaaaaggaattcccttgaaggatatcacccggggatccgccgccgggatacccctgaccagaccgttttccgtttttactactttcagcatattgtctcctttctcacttcactcttatcatcattacgctgcatgcaggcatcatgaacgaaagtcctctgtccgtcacctgtatctgcgtaaacgcttcttcctttacctgttccggctcttcaaaggtattataggactgcatccttccgcgcacgattttcgcttctatccgggagggctctttctttgtcagaaccacttccatctgtctgtcttcctccggagacaggttattcagggtaattgtcagaacaccgtccttatccaccgaaacggattcctgcacatcgggcaccatctcctgttccttcaggccgatttttcccgccccttccagccagctttccacaagctccgcatcctgatgatgcttatacatatggaatacatggtaggtcggcgtcaggagcattttctttccctccgtcaggatcacggactggagcacatttacgatctgtgcaatacaggccatcttgatccggtcgcagtgcttgttgaaaatattcagggaaactcctgccgtcagggcatccctcatggtattctgctggtacaggaagcccggattcgtgcccggctccacatcatgccagcagccccattcatccaccatcatcccgattttcttttccgggtcatatgtatccataatggtgctgtggcgtgtaaggacttcttctatataaagagcccttgcaagagtattaaaccagactgcctcgtcgaagtctgtggcgcttcccttatggattcctttttccaccccggcgtaatagtggacggacaagccatccataaagccgtgtgcttccgggggagcgggatttctgaagcattccctcagtaccacatccgtccattcatagtcatccgcattggctccgccgcagattttgaatatgggggcattcttgtcatagcagcggatataggtctggtatctgcggtaaaggtgggcgtaataatccggggtcatattgccgccgcagccccagttttcgttgcccacgccgaaataatccaccttccagggcttttccctgccgttttcacggcgccagtccgccatgggggaaacgccgtccagggtcatgtattccacccattcgctcatttcctgcaccgtgccgcttcccacatttccattcacataggtcttgcagcccagctgctcgcacagctcgaaaaactcatgtgtaccgaagctgttatcctccgtcacccctccccagttggtgttgaccattttctttctcttatctttaggccccacgccatccttccaatggtattcatccgcaaaacagcctcccggccagcgcaggaccggaacctttaattccttcagagcctccactacatcggtgcgcatgccgttgacattgggtatttcggaattttctcccacataaaggccttcataaatacatcttcccagatgttcgctgaaatgtccatagatttccggattgatatggcccatttttttattttcattgatgtataatgtgatcacgcttttctcctgctctctctttattttctttttctgggatccagttcatatatcctgcctgtttccagcacggcaaagggtccgggcacccggcgttccccgcatgcgtctccgtcaaaagcatccgctgtttccatggaagccttaaccggtagcaccttctccggttctgtgatatagttctgccttcccgtgccatgatgcctcatttcaggcagtccgtccgcctttttcaattccagggtgagtttttccgtatccacctcaactgtaaagaagccttcctgcccctctttgtcaaaaccatagaactcctgccatgcctgcagatccaggcagttctccggagcgggatacagaatgcggaggtagcctcccggcattttcacatacagattgccctgggaatcgttatctttggtggggaatttaatggcggcttccccgcaatcatagaacatgttgttcacgatcctggcttccctggaggtgcctcctcttccgtttccggagatacggaaggcgacaggtttgacaaaatatccggcgctgcggcatcttccgataaaattgttcaccacgtgcaggcggtccgtaccttcgccgtacaccgcatagccgttgatttctccggtctcctccatcttgtaccagcccgtggagcccggctccgaagggatatcctccggccggaaccgtccttccacattccagaaaatattattgtctatcaggttgattccgtctctggagcattcgatgaaaatggcctctctctgctcgattccatccaggaacagattgcgggtgatccggttattttcatttcccacatccatccacagatgatccgcacggaaggtcttagtaaaaatattccgccgtatcaggctgttcacactgttatgtaccttaattcctcccgcttcccaggaaagctccatcttctgccagccggttccttcgatccggttgtcttctatcagcaggtcggtggcaaacatgcctgcaatgccgcacactccggcatcgcgaatttcacagcctctcaccaccgtatgcccgatgatctgattctcccggaaggtatggtgccagcactcgttgccgatatcaatccccacgccgttagaccagtcaattttacaatcctcaatgatccagtggtgtcctctgtagcatgaaatggctccgcgctggggtacgggcgctcccgtcgccgcatgggcacaggtcaggccctttaccctgatataagaaaggaaaggaatctcaggcgcaaagcactgttccctgcacgtcagttctatctggtgctgtgccggatcggagtcatcctccagccggaagtgtacggtctgtccgttggcctccacccagtaagatccgggcgtgctgccgagctgattgtacaaagaaacctgcttcagcggcttcccgtcacagaataccatgcctctccggtttaaataggtcgtcatatccgtcttttcatattcgataaaaaggcggtcatggaggatatttacggcgcagaagggattgtagcccctgaattcatcggggttgagccttgtctcccatatctgcagcccttccggcaggcttacctgtactccgggaggtatcagattccagccttcgctgcggcggaaatcatgggtctccaccgatgccttgataactgcctccccatccccaaaggcttcgaagctcaccatctcctccgggccgtttcctccgcataccggatggacgcattcccggtaaacaccgccgtgaatccataccctggttcccggccccgccagattggctgctgcctgaatggtcgcaaagggatgttccatgcttccgtcattttcatcgcaggcttccggatgggcggcattcacatgatattctctggtgaataccggtgtcttttcccagaaggcaaagcgttcccctcccgggaggcggtcctgcgtatcaccttccactcgtccgggtacgctcagtaccgcctgataagccgttttcggccggaaaccatcctggaaaagcaggggaaagcttcgttctccccgaaaaccggtgagccagctgtcatcgtcctgcatcccccagaaggtcacgccggtcacatcggccgccccttcctttttgtttcttatcaggatggtgaaaacctccctgtagcgggccgcaagggcttccatggacgacgccgacggatctgcattatgaatatccagctccgtcacctgaatctggattccaagggagccgtaaacgcggagtgatttttcatattcctccaggtcaggcgtgttcatggtcatatgggactgcattcccatgccatccaccagctgttccgaaagcagcggctttaagacctgttcgcagatcacatcccgtttccagggaataaaggtatcataatcattataaaacaggctgacatcctgctttgcatactttctcgcaaaccggaacgcctgcaggataaaatcctcacccacggtttccgtccacagggaacggcgcagcgtcccgtcctccacggcctcatttaccacatcccatgcatagataattcccggatattccgtttgggtaaattccagtacctgtcgtatatacccctccagcctagcaagcatagtctccctgtccgcaaggggagcatcctcttccccgcggtacccttctgcaaaaaaccatctgggcgtctggttatgccatacaagggtatgccccctcattttcatgccatgctcccgtgcaaaatccaaatatttccgtacgccttcaaaacatacggcgggacaacggtcatactgcgccgcattcctcctgttttcctcctcatccagaaggaactgcggtttcatctcattctcacaggtcatggaatcatactgcacgcacagctcccccaaagctgttgtgctctcaaatacctgcgccggaacggcggcccccatcttgaaatatggctgatatactgttttcagactcatgtcattcccctccctccgcttctgcggaaaatcacaaatttaccgtaaccgttcagacaagcccgaaccgttactgtgtccgtaaaaaagagaaaaaggggccggcaaccgccagcccccacttttctgtcattcctattctgctcttattctgctgcttttcttgcgtcaatgactgcctgatatttatcggtatcaaaggcaaccaggtcattccagccgaagccttccagctgtacgcacatatcgtcccacatcttttcaaattcttcatcgcttgctgcgaataccatacgccaggaagcatcacatacaacgctcttgcactggcttctgatcagtgcggtatccgtatcgtcacttgcaagaggaatatttacattggcaaccatgccgagctggtttttatctctcatgtattccacttcatttacagcgccgaatttttcagtccattcctctgtcgtggctgtctgattcagcttaatcatagatgcccataaaccaggctcgaaatactctcctgttacaggattcatttcagcgcttcctacaatccactgattaacctgattgtttccatcactccagaggccgcctcccaattcttccggaatctgtacatccgcggtaaaacgattctggccgtcctgagtcagtgtataagttccatcatcattcacggtataaatcaggccttccaggctgttatgctgataagtaagcccttcaggagatgcaagccagtcgagcagttccataatccgtaatttcttttcttcatccacctgggaaccaacaccccagacacgaccgtcaccataataggaatccgctgtctggaagaagttcaattcttctacaggagtgtacatataattttcacggcttgctccatgctccggtgtattccagaagccgttctgccagttataccagaacaggtatactctcttctgtttcatcttgctgtcgcaggctgttgtccagtcctgagtagcggagtccggatcaaccagtcccatccgattggccttatagaaaaactgaagagctttgtagtaacctccgtttttatccgtcaaaggcatgatggtattgtcattgccaagaagaacggattcctttacctgctgtccgaaccagtttgtcagcagattggcattttcaatactgccgccatcccagtccttccacatggtaatcgcaaatgccttgtcgcctgccgcatttgtaggatatttttcctgcatatccgccagcatgttcagaagatcatctgtggttttcagttccgggcatcccagcccttcatacagatcccatggcacccttggcgcgcttgccacttctgttcccacaaatgccgtagggccgttgctgttcatattacagggaatcgcaaaaacacttcctacttccacaccgctcatggttccgttaaacagatctatctgctctttgtacttggtcaggttttcgtagtttccgataatatcgccgatatccataatcaggccggcttccacacagtcctgcatttcggaattgtcaatgattacgatatctcccagattccccgatgcgcttcgtgtctgataaagagaattggcatctccggacacctgcggtgcgataatattaagctggatattgaatttgtccttgagcacttttccataccagcctgcctgtattccctggtaattggcggctttatcatagatttcgatggtcatctccgtatcatgggatacctcaggggctgttccctgtgcagcctccgtacccgcactgctttctgccccgctttccgctgccggttctgaacttccgcctgccggcgctgttgtgtctttgccctgtccgcagcctgccagaacagttgaagctgtcatgattgctgccagtgccagggatgctaaacgtttccttttcatcttgaatcctccttgttttccgaagaaaaatatgagcctctgcgaacagagtattttcctcctgctctttattgagtctatctataacagaagtcggtcttctgctattttctcagccttttacggcaccgatcatgatacccttaacaaaatatctctggaatatggggtataccagaatgatcggtatgactacgattattgttaccgtcatccggacgctggtaggcgtctggcttgtggctactgccgccgccatggaagcgctgttattggtattggcaaggccggccagcgaactcgcctgattcagatattgatacagaatgaactgcagcggataaagcttggtatccgttaccagaagcagtgtatcctggaaagagttccactggtttaccgcggagaaaatcgcaacagttgccatgataggcttgataaccggaagcataaccttgaagaaaatcttcatgattcccgcaccgtcaatctgcgcggcttcctgcagctccttgggcaccgactccacaaatgttttggtcagtataatatagaacggggacaccactgccggaaaaatatagccccagaaattattcgtcagatgcaggttcctcatggtgaggtaccaggggataatacccgcattgaaatacatggtcgccaccaccagccggtaccaaagcttcctgtgccacatattatcctgagtaaacataaagcccaggaaggcggaggcccctaccgtacccaccgtaccgataatggtcctcagcacggatattttggccgcctggaaaaggccgtcaatgcgcagcgcactgagatagtttttaaaatgaagccccttcggccagaacagaatcacaccgcgtgcgctcaaatcattggcacttatggtatttatgaaaatatagtaaaaaggataaatacaaattaaggcacaaagggcaaatatgatatagcagacaacagccagcatattatcgccgaagctgtggtgcatctttgttttaagaactttttccctgctcattttttcctcctcttccctacaaaaagctttcgccgcgtatcagcttggacatggtattggcaaagaacaaaagaatgagactgacaacactcttaagcatactgattgcaacggatacagaatagcttccgcttcccatcgcggtgttgtatacgtaaaggtcgagcacctggatcgtctctttgttaaaagcattctggaatacatagtactgttccataccgttggaaaggaagttcgcgatattgagcatcagcaatacaaagtatgtgggaaggaggctcggaatcgtgatataccaaatcatctgcagccttgacgcaccgtccacctttgccgcctgatacatttcatcatcaatcccggaaatcgccgctatgtacatgatggccgaccagcccagattcttccatgtaagccacagccacatcgtcagccatacatgttcggaggactggaggaaaagaatcggctccgtagtaatccccagcgtctgaagcagagtgttcgccatacctgtgctgttgaaaaggctgtatgccacggaatatacaagcacccagctgatgaagttgggaagcgtggtcactgtctgcacgaatttccggaagggcacacaccgcagttcattcataaatacggcaaatatcatgggcagccaggaggttgccagcgtaatgccgctcatggcaaaggtatttttaagcacctgcagaagctgattgattttaataggattctccaccagagacttgaaccatttcagccccacaaagtcatggatggaaaatggtttcggcggtttgtaatcaaaaaatgcgtatacccagccgtacagcggataataggcaaaaattaaaaccagcacaataaagggcagtacataaaggaacattttgaaagaattccattttttcttgttttgaaaaagactcatacttctctcccttctcccaaagagtttacattttgtttatcgttaaacctttgtttaaaaggattatataactcttccaccatgaatgtcaatatatgttttaatatattatgatttttatacaatttacacatatttttattcacttaaacgatttaggaattttctatttgtgttatttttatgttatttgcactaaaatctacatatgtatcgttttaccagtttttatattctatatttacaataatggaaaatgcatttctattttcatctgccataaagacttctgtcacatcaagatgtcatccgtatctcttccaaacggtatccatcaaaaaaaaggtgcatggccattattataatttccatacaccttactgttactatgtaattttattctaaatcatcttcaaaagctgtatcagcccatgcgatttatctgtatctggtgcggcttctctggctgcaaatcgtttaaagccatacctgctgtaaaatgaaagcagcttttccttatcctctgcttctacaaaagctaccataccgcctatctgatactgcagcttttgtgtctgcttgattgcagcttccaacaattcttctccggttattcttcctattgcattatcgttgaaattcttgccaaactgtgctatcaaataagctgctaaattatatgtctgctcacttttattaatttcactgaatctggcaagtttcctctttaccgtattgccaaatggctctgcattaacaacaagaggttttattgtaattgaaaaatatccaagcaacactgcgtcttctgatgacaataccaaataggtaaccgcctgatgcttctttacaaattctattgactgttgtttcaaaaaaagctcaacatccgggtttaatggacaggaaaactcggaaaggagttgtgctaacttaccctctccgagttcttcattttccaaatactcacgaatgtttaacacgataaaattattcgctggcgacattcgctttcttccttttttccatgaattttaatatctcatctgcaccctgcaagtaggttacattgatcggaacacgaggtgttctgtcattggcagatgcttctaccgcatcggcaaacatctccacctgttcctggccggatataataaaattcttggtgatacttgaagttgccataaaaacacctccttttttagtatggcttgcttttaaaaaaatactatattctaattatattgtattcgctaaaccctctttttgcaatatattttttgaagtttatatgattgctttcataaataaaatgaacacacacctattcacaagctataggaagccaggaataggacttgcaggcagcagccggtaaaacccaatcaaaacggatccttcctgcaggcatacatccctctgaatgttccttatgactgcttccttttcaccgaattccgcagcacgatagaacagggaatcttgatttcagccgccttttcatccgcagcctccgcctccttctcctcaccgccgatcctctccagcagcatctctgccgccttatgcccgatctcggaaagaggcaggctcatcgtcgtcagcgccggacggatatattccgacagatcctgattatcgaaaccggtaactgaaatatcctctccggccctcagcccatgctcctccaggtaatcataaacaccgcccgccatgcggtccgccatacagaagatcgccgacacgcccgcatccacaagcggccctgcctgctcatatcctgattcccgatcccaggctccataacggacccagcccggattatagggtacctgctcttcaaacatcgctttctggatccccagaagtcttttctgggtatgaatattatccgcccgtccgccgatgatgcctatttcccggtgtcccatggaaagcagatacttcatcatatcatagccgcccttttcctcttcaatcaccacagacggaatccattcggcattcgtataggcatatgccagcaccaccggcatggaaaaatcctccgggaaaaaatgaatgatcctcgcatgccccgccacataaatcaccccgtccactttaatggaacgcagctcctgcagcgcaggctccagcacggaacggtaggcttcctcgttattgtaccaggattccttccacctcgcatacagacgaaggttctgcacgattgtccgatatcccttttcttcacagcaggccataatgctttctatcattccgggcgtactgaactgggaaatatcttctgcaatgattcctatcgtttttgtcttctggtttctcagcccctgagcgatataattaggctgataccctcttttcttcaccacatccaggactctgagcctggtttcttcgctgaccttcggcttcccgttcagtatattggagactgtggtggcagagacattacactctctcgcaatttcctttaatgtaaccataattataatagcaccctctcttttcctattacaagttttacgttaaacaaaataatgcccttattttctttttcaggcattccccttttttctgaattcaataaggaattatagcattattggccccatcacgcaaggagcattcattttttcggcaggtttacagaaaaacctgtatacatccgccgtaaaccaactgaagcttgtttccccttggctaatatgttacaattctttcacacgaaagcggtattagtataacctgactaagatcggggccccatggttcccgtttttttgccgccgtttggcgtggagggggacacatatggataagaggacaacaaacctttttgcaaatgtaaagcagcgtctgctggcagggccgggaaagtttctggataaccttcccctcgccagaaaacttatgctgctctatttatgctgtgtcctgctccctttgatcctgactgacagcgtaatcatttacatgacggtacgcgccgagcacaataccagccggcatgaaatggaaaatatcgcggacgctatcaaatacagcctgagcaaccgtatggataatgccgccaatctttctctgaatatttacagcaataaatatatcaatgcctttctggaagccgactaccaatcccccctggactactttgaacgctatcaggattttctgaaggattccctttatgaagccagcgttgtgacaagcaattatcagattgtgatgtatacggataatcccggtatcgttaacggcggcagcttctggaacctggataccataaaaggagaacagtggtaccgggattttatagattccggtcaggaaattctcgcctatccctactatgaatcctccgtcacctcttcacagcggaaaatatccatcatccgcagaatggactactatcataaaggctccggccccaacctggtgaaaatggatctggactacagcagtatgtcccagagtatcgtaaacgccaaatacagctttctcgtttatatctgcgacggggatactatcctcttttccaacgacgggcacggcggcatgggaaagccctatgagaccttcacctccgacctgctgaagaaaacagggatttcaaagagtatgaatgtatacggacgggtatggaatatttatgtcctgaacagggaattaagcgcccttgctctcataaaaaacaatttccaccttctgattttccttctgtgtctgaacctgcttctgccggccctgctgatgaccggcctgaatcattccttcacctcacggctcatggagcttggcgcagcttttgaaaaaggcggcatcgatgaactgaaagccctgcccgcggtgcggggaaaggatgaaatcggaatcctgatggaaagctataacctgatggccggccgtatcaacgacctgatacagaccgtttacaaggacaggctcaaggaacaggaaatggatatcgccagacagaaagcggagcttctggccctccacagccagatcaatccccattttctcttcaacgccctggaaagcatccgcatgcacagcctgctgaaaaaggagctggaaaccgccggcatggtggaaaggctggctctgatggaacgtcagtatgttgactggggaacggattccatcagcatccatgaagaaatacagtttgtggaagcttacctggagcttcagaaataccggttcggcaatcgcctttcctaccagatagatgtggaggactcctgccagggatactgtgtccccaagcttaccctggtcacctttgccgaaaatgcctgtgtccacgggctggaaaacaaaaccgcggcaggctggattttcgtccgctgctactgcgacgaaggcgtactctgtatggaggtggaggataccggccacggaatgagcccggatttggtccgtgacatgcaggaaaacatgaataatgccagcatgcagctgctcaaggaaaaccgccgggtgggaattatgaacgcctgtctgcggctgcgtatggccacaggcaatcaggcctgttttgagctggaaagcgaaaaaggctccggcactatcatcacaatcaaaattcccgtggatgcactccataaaaaagcatggaaacagaatgaaaatatataaatgatacagaaggaggtacctgatgcttcgcatattatttgttgatgacgagccctttatcctgcaggggctttccgtcctgatcgactgggaaaaggaaggatttgaaattgcggggacggcggcaaacggcctggaagccatccgttttctgaaaaacaatgaagtggatctgatactggccgatatccggatgcccgccatgtccggcctggagcttctggaaaagctgaggacagaaggcatttccaatgcctattttatcattttaagcggatacagtgactttgaatatgcaagaaaagctctccaatatggctgtatggattatattttaaagccggtacgaaagacggagctcatagccgctctcgacaaggtgaaggcagaaagcagtctgaccctccggaaaaaggaagaggaagcccttcaggaaaaggcatattttgcacgaaacctcatcgccattatctgcggcaaatacgatcagatgaacctggaatatgtgaccgcaaagatgcgtacggacggcggcatccggtatatcgatattgaaattgatgaccgtaatgaggaaggctccgaatacgagccgcctaaaacagaggaagaaaaaagaaagctgcagaggtttctgtaccaatcctgtctggattttctgggagaagacggctggcactgcattttcgatgtatccagcaatgagagggattatgatatcggcctgatctactgtgactatatggcgcaggaagccggaatgaacgagcaggattatctcgacagcttcctgggcagcattcaggaagccatcaagcatccggtcgtcatgtttgtgggaaaccgtgtggagcatatatccgggctgtccgaatcctaccggaccgccaatatcgcccgctcttttcagaatttccatgttgacgggatgaaccagtgcatttcctggtatgaggaacaggaacggacggaaggcagaagcctgctttttaaggccagtctggacgatctggccagagctgtggaacagaatgacaaggaacggatacctggccttgtggaccatctgtatgatgaaatcaatcaaaatgccatggatgccaagcttgtgagcctcaatatcgactatctcctctttcagcttgtccatctggcacaggcccaggatcccaatgtgaaccaggaggaaatcctggaatttatcagcggaagcgcttttgattccggtaccatgaggggcagccggatgcatctgaagcgttttgccgaagaatatgcggattacctttcccagatcagggggaaaacgatacgcggcggcgttctcggggaggtggagcaatacatccgggaacattattcggaaaacctgaccctgaaggagctgggccagaactattacataaacagcgcttatctgggacagctgttccggaaaacctatggtgtctcctttaaagattacctgaataattacaggatcgaaatggccgcctcctttctccttcatacggacatgaagaactatgaaatcatggaaaaggtcggctaccatgatctggactattttatcaataaatttatcgccgcaaagggctgcactccggccagattccggaaaaaatgcagggaatagcaccggccgggagcacagttctttgtccacttatcaaaaaaagccctgataaattacagttcaattgtgcaactataatttgtcagggttttttatgtattttctcaggttgttgttttgtgtagttggtatagaataaatacacaaggacatacccgggtatacattttgacaatgcattttaataagcaggtaattaagaaatatcaggaggattcagaatgaaaaagaaacaactgacagcgcttttactctctgcagcaatggcactttcccttttatccggctgcggcggcaatgcagcctcttccggaagcaccgcttcccaggaaagcgccggcgaaacagagagccagggaactcgggaatacaccgcattctttgccgttcccggaacagagatcaatgacgacaacgaaatacaggctgtcatcgcggatatcacaggcgccagagtcaaggaaacctggctgacaggccagaccgcccaggaagccgtgggaacgatgatcgccggcggggaataccctgatttcatagacggcagcgacggacagattcagctgtatgaagccggagctctcgtggccctggatgattatctggataaatacccgaatattaaggagttctattccgatgcggaatgggataaggtacgtcaggaagacggaaaaatctactggattccccagttcggaaatatctgggaaaaggatatgagcgccgtacacagcgacgaggccttctggatccagacccgcgtgttaaaatgggccggttatccggaagtaaaaacaatggatcagtattttgacctcattgaaagctataacgaagcaaatccttccatggaagacggaacggcaaacatcccttataccatcctctgcgatgactggagatacttctgtctggaaaacgctccccagttcctggatgggcatcccaacgacggctccgttattgtagacacggataccctgaagattgtggactataacacaacgcccacagcaaaaagatatttccagaagctgaacgaagaattccagaagggaattgtggatccggaatccttcacccagacctatgatgaatatatcgccaagctttccacgggccgtgtgctcggaatgattgaccagtggtggaacttcgcttattccgtaaatgattccttaaaacagcagggactggataagcagggctgcgattatgttcctctgcctatcaccatctcggaagatatcaaaaatatgtggcatacctccgacggcgccctgaacgtatcaaacggcctcggcatcaccaccagctgcaaagacattgacggcgctctccagttcatcaatgatcttctcagccctgaagtactcaccctgcgcaactggggaatcgaaggcgtagactacaataaagacgagaacggtgtcttctcccgtaccgatgaaatgcgtaccaatgcttctgatcccgcttacaaggcatcccacctttgcacctattcctatttcccgaactacagcggcatgagcaaggatggaatcaacgccgccacccctgccgaacagcctcaggaattcctggacggtttacaggcggacgtacaggaatgtctggaagcctacggctgttccacctatgtggaaatgattggaaccaatacacctcccggcccctggtatcctatgtattcctacagtaacactatgaccacctccacccccggcggaaccgcctggacaaaaatgggagaaatcaagcatgaatatctgcccaaggttgttatggcttctgattttgaaagcgcttgggaagaatacatgaaagtttattcagactgcaagccggaagatttcttaagtgaaatgcagaccgagctggacagaagaatccagctggcaaaagataacggcgaatattaagcagctgcaggcagcagtggttacgatatgtgattacggctgcctgccctatataaaggagcagttatggcaggaaatgcaagaaagaaaaaaaagaataagacggaaattacctggaaggaactgaggagacagaaggtccttattttctgggccgctgtttttgtaatatacggctttatcttctgctatcttccgttaggcggctggctgatggcctttcagaactataaacccaaggacggtatcctgcattcaaagtttatcggccttgccaaattccagcagcttttttcagacgccacctttttacgggtcatccgcaatacactggccatgggcgtcatcaacctggtgctcaccttcgtcatggcgatcgcctttgccattttactcaacgaagtgaagtccaaaacgggaaagaaaacggtacagaccatctcctatctgccgcattttctttcctggatcattgttacggggattctccacgacgccctctccggcaccggtattgtaaacgaactgctgctgaaattccacattctggaacagccgctgaatttttttgcttatcccaagtacttctggtggattgtggcatttgcaaatgtatggaaagagacaggctggaacgctatcatctatctttccgccatcaccgccatcgatccttccctgtatgaggccgcatccatagacggcgcgggacgctgggccaaaatccggcacattaccttccccggaatcaagccgaccatcatgatacttcttctgatgaatgtgggcaacgtgctgaacgcaggcttcgaagtacagtatctgttaggcaacggccttgtgcagagcgtttcccagaccattgacatttacgtactgaaatgggggatcagccagggtgattatgctatcggtacggccgccggtattttcaagagcgtggtcagcatcatcctgattgtaatcgcaaaccaaatggcaaaacgcaccggcgaagagcgtttgttctaaggaggcagaaaaatgaaaacaaaaaaagaatccggacaaaagggagttgtttacaactcctccgtatccggcaaaatattcaccgttttaaatacccttttcatgattgcctttgttgtaatcacgctctatcccgtcctcaacacgctggcaatctctctcaatgacggcaccgactccctccgcggagggatttacctgctgccgcgtaaatggaccctgcagaattataaaaccgttatacataaaaacaatctgattaacggcgcggttgtttccgttgccagaacgattatcgggactctcaccgctctcgcctccaacgccctcctggcctttatcgtcagcaggaagcgttttctgttcaagagccagctctccctgttctgggttgtcaccatgtatgtaaacggcgggctgattcccgttttccttctttataagggcctgggactgaccaacagcttctgggtttatatcgtccccggcatgctcagcgcctttaatatgctggtcatccgcacctatatgacgggaatcccggacagcctggaggaatccgcccagctggacggggcgggatatatgaccatattcctgaaaatcgtatctcccctgtgcaaaccggtatacgcaacagtagccttattcgttgccgtgggccagtggaactcctggtttgacgcgatgctgtataatagaatgagtgatcagtatacaacgctccagtacgagctgatgaagctgctctcctccgtcaccaaccagggggcaagcgcggaatccatgaaaaacgccacggctgcaagcgccgtaacgcctacctccgtgcgtgctgcggcgaccatactgaccatgctgcccattgtatgcctgtatccttttctgcagagatattttataacaggacttactattggcggcgtaaaagaataactcaaccgaatcggaactattgtaaggacacagaagaaaggggaaagaaatggcaggtgcatttgaaacaggggtttaccggaatgtatttatggaatgcggcattccggaggaagaaattgaaaagaaggtatccgacaccttccggactatgttctacggaaaggaggaggaacggatttatcatgaggcaggccaggactgcggcttcctcaccgataccggaaacaacgacgtgcgcacggaaggcatgtcctacggtatgatgatgtgcgtccagctggataaaaaagaagaattcgaccgcatctggaaatgggccaggacgtatatgtacatggacgccgaaaccctggcggcccatcctgaagcaaatatggaaaacgaaggctatttcgcatggtcctgtcagctggacggaaccaaaaatgcctggggtcctgcgccggacggtgaagaattttttgccatggcactcttcttcgcttccaaccgctggggcgacggagaagggattttcaattattcagcccaggcgcggaaaatcctgcatgactgcatacataagggagaaaaacccggtaccggaaagcccatgtgggatccggacaatcatctgataaaatttatcacggaatgtgatttttccgatccttcctaccatcttccgcatttttatgagcttttcgcgctttgggctgatgaggaagacagggaattctggaaaacagcggctaaggccagcagggaatatctgaaaaaagcctgtcatcccaagacaggcctatgcgcagaatatgcggaatatgacggaacccccgtgtattcccagcccggcggcaatgaccgccacgactggtattacagcgacgcctaccgtacgattgccaacatagggctggattacctgtggtttgcggcagacccctgggaaaaggaaatcgcggcgaagctgcagcaattctatcaggaaacagccaaagacaaccaggacggggttttcctcattgacgggactccggtggagcaaaaagccctgcatccggtggctgttatcgccacaaacgcccaggcttccctggctgcggacggagaatacgccagggactgtgtcctgaaattctggaatacgcctctgcgtaccgggaacagacggtattatgacaactgcctgtatcttttcgccctgctggccctgagcgggaagtaccggatctggatgccctgaatacaattcagactgccttaaactgcaattacgctgtcaggtcaagtaacctgacagcgtaattttatgcttccgggcattcattcaaaacttataattatcgtagtttccgtattctctccagatgtccagcatcatctcatatctctccagggccattccggtatacacacaattggaagtggcaaacacatatccttttcccgcttccattccctgtctcagggcgcgcagcacatcctgacggcattcctcatccgtaccggtctgaagcaggccgcagttcacatttccgatcagggcaatgttttctcctgcaattttacgtacctccgtcagatccactccgccctgaggatccagggaatggatggcatccggcttacagtcggccatctgttttacgataggcatgatatttccgtcggtatgtttaattgtgtaataccccatcttccggtactccgcaatcacttccttcagataaggaacaatcagctcgtcaaactgttcactgttgaagaaagggttcacattaaagcaataatcggagcacagggcaaaaccatccagcagatggcctcttgcatcgaggcctgcggcaaatttcaggctgttgtccagtctttttttgctttcctcattcaaaacctcaggttcttcatacatctgtgcggcaaaatccatcatggaatcaccatcgggaatcgcccaggtaggatccccgtgcatcatgatatagtattcgtccccggttttttcccggatcgtctcaagcagccactgggtgctgtccaaatcaccgggattgggatgaataaagatggcgctgtgatcgaaacgctttgccgtagcaatatagatatcggccatatcttctatatgcagttttctctccctgctgctcatctggttccactgctcataaaagcgatgggacgggtgaaccttgccaaaggcttccatcgtcagaaaaaagaccagttcaaaggtcggcacctgacctccgattttttcgcatttcagcgtctttataaaacgctctctgtgtgtcatagtttaatcctcccggtatcatggtgagatgacagaaagctgctttccaaaccagcagtgacaggcagctctcttatctgtatttattctcaacactatagcttttttcggatataaaaactggtaatttctaaagatttttggtaattttatcttctttgttctccgctgtttatccctgtctgtttcctggagcgcataataacaactgtaaggcaaactatatagacgacaggaggaaacgacatgaaccaatacagcaagattaccgcgcgatactcccgcctttcagttggtgacgaggacagggacggcaatgaaagtaacagcattcagaaccagaagattttttgaccgttccgcctacgtgcagcttatcgccatcaataatggtatagacagcacggagccacgcacattggagtttgcgccgtttatcaatatcatgtcggagtggtacgcaagggacatcagcaaaaagtgaaaacaggcattaaaccaaaaggaaccagcatacagacaaaggcatggaaaacggagtatgctaagctgaccgccgaacgaaaaacgctcgatcagcggtatcttgcactcaaagacgaggtaaaagaagccgaacaactccgcaagagcatttacagtatcttgcggcaggaacaacgggaacagcacccctgccgagcacaggacgtggaacgctaaaagacagggcagcgagatagtcaacgccgcccctgccgccctgtcttactaattatttttctttgcaagcgataccataacctagattaaggggagaaactcctctgcatatctcgtattttatcccggatatttcaacttcatcatcccccgtaaaaacgcaagtttccccgtttgcttcacaatacttagatattgcttccatcgcttttgcaggtgtcggatactctgaaatatcttcgtatggcacatcaaacgctttcttaaacattttatgcataaaaacaccccccttctacgtcatatttgtaagtacattcaaaaaaagcctaacaatatgtcttattcatctaatgcaaatagattatactactttaatttgctttaaacaagggattatctctatattccgtacgttccacctatccagcctatcaatggacgtgtagtatttttcagcaaagaacgcgaaaaaatctccactcttgaaccattgacaggttggatttttaccatgccattacgccgccgacaacggagaacagaattaaggccataacatgactgtccgatgtagacatttagacttccttttcagccggtaaagccgcatgaatatgggcttctttgccctatcattgccccgtttccgcaggtcgtaaggtttaatatcacccacccatgataaccggcttctaaccgtctatatgagaaaattgcgtcaataaacaaaaataaaacttgacaaaacgcttcatgatgggcaaacccgtaccttcaccccttccggcgcctgataatccagccggaactttccgttttccttcttccaatccaccttcaccataccccacttcgtcgccgcttctccttttgcccaggtaaaacagccctccacaggggcgattccgatggtttcatatccgggttcttccggatggacgcccagaactactgccggcagctcatagagggcaagagcgccccatgcatggcagtcgctgcgctcgttcactccgtcctccacacaggtagtgagattcttcttcaccatattacgccacagatcccattccctgtccgtctcctcatacaaaccggccttctgcagagcgcggaaaaggtaatgagccatggccacggagcactgtgcgtaatccgcctttgcctccagagtccttttcaggttttcccgtcccttttccacggaaaccgtatccgtaagcagggcaaacacctgacagtgctggctgtattcccggattcccgggccgtccgtatacatgcctgcctcatccctgcaatatatatttaccgcctttctcacctcatccgcccggctgcggtactcccgggccacctggctgcgtcccaggtaatccaataccttggccgcatggtcaagccccatgatataaagaaggctttccatggtgatcggccccgaaaggccggcacggggcatgcccgaggtttcatcccactgtgcggtccagtcgatgaatgaccagtaacggtcctttccgttaattcctcccatccggcctgccagccctctctcatccaggttcctgcggaaatattccagaatcccgtccaccgtacccatgtgctgacgcaggaactccctgtctccgaaatacatcatgtgatcataaagcatcaagatataataaatggagaagccgggaatgacattggggccgtaacagggataggaacagttcagaagcccgtcataacgctgcgaacggcggaaatcatccatacattttctcgcaagccggtcatccgccgccaccatataggtatataagatctgacttctggaatccatggcatactgaagctgttcataaaaagggcagtcctcataggtttcatgcatgcaccgtttcaaggtgcgcaggctgatatcccacaccgcttccagggaactgtccgatgtggttacctgtgttctggcctccagggggtaacctgtttccagataatcaaagcccgtcaggcagaggggctcctcgcccgctgtgatttccagccggataaaccggaaggtacggaaccagaatggctcataggtctcctcctgatcgtctttcccatagcccgccacatggtaggtgtctgtgaaaccatgaagctgcccgttctcccagtcgcagcggtctcccttgcggggcagtctcataggtcctttttcttcctcgatccgcacatacccttccgaggtcaggaccttcaccgtacttcccgcccccatctgcatgcgcagggacaaaaagcccgtattcagctctccggcattgatttccacctccgtccggctgtgcggcgcgagcataacatgtccgtctccggaaagcatccgttcccattcctcttccgatgcctccgaccgcctgatgcagacaaggcctgtaaaccggcgcatttccttgcgcatataagggatggtgcgttccagcaggttccccggactgaccgctttgctgaccgcgggctctatataaacaaaggcatccgcccagtccccgtcctgataccccggctccttccagcccgcatccccggcaaacccggaacgttcctccagtatctggagcggggcgaaataaggagattccgatatgattcgaaatcccttttccatgctgcacttccatgagggatcgccggatattcccagcatgttttcttttccctgctgctcttttacatacagccccggcatttccgtccggaaaatcccgtgatttcctttgctgtgaagcatgggatacctaagtacctgggccgcgatcacattttcccctgttctgagaaacggagcaatttccacttcatcataaaaccagacctgccgatcccccttgctcgggccgatctccgccagcctcccattcacataaagcttataccgggaatccgccgatatccggatccggcagctttccacaggttccgacacaataaattccttacggaaacgtgcaagccagcattcattctgatccattttttcccacccgggaacccacatccaatttgataaaggtattttaaattccatgtattctccctctttggctttccttccgtgctgccccgatacgccgcacgggaagccctttctgtataataacagcctaccccttcaccgcgccgatggcaattccttttacaaaatatttctgaaaaaaaggatatgcagataaatccttccgcatatccttgccttcttatttataaaagctcacgccctcttgagcgcataccgctcatccttctgcagcatgaattcctccatttcctcttccggcatgggcttcgcataaaaatagccctggatctgatccacgccgaaatccaccaccagttttctctgttcctccgtctccacaccttccgccactaccttcattcccagctccttgaaggtacgggacaggtttttcaccgcaagggcggacttctcattttccatggatacccataccaggcttttatccagcttcaccgttccgaaggggatgtttatcaccgtcgcaatattggaatatcctgtcccgaaatcatccaggcccatcttaatcccatgctccagcatccggagggtgaactccgtgacggcctgtgtgctttccgccagcgtgctctccgtaaattctatttttatggcggacatgggcgtatggtttctgctgattatttccaaaacacgctgctccagatccggctgggaaaactgcatggcggaaaagttcacatggatggattctatgggaatttctttttccagcagccggttgaggaagcggcataccttatccagaactacataggtgatatccacaataaggcccgtttcttccgctatgggtatgaactcatccggataaatggggccgatgggagaatgcgggatccgcatcagggattccgcatggtcaaaacagcctttttccacgctgtagataggctgatagtacatttcaaagctctgctgctccagctgttccttcaggatccggacgatctgtgtgcgccgttccagctttttcatcatagccctgtcacagtagcagatcgatccgcatttgccggacttcgcctggaaaattgcatattcgatggcgctgaccgtatcctccagcgtctcttcctcattatgacggatagctcccataacaacggacagccggaaccggtaattcccactctgccagggctgttccatccgcttttgtatcgtttccacacatctgcgtattttatcatcctcagcttcggggaacaaaagagcgaattcatccccgttaaagcggtaaacattttccgcaggccctgcctcacacaagaaacggcagaccattttcaggaactcatcccccttttgctgcccgcaggtattattcacctgacggaaatcccgcagggataccaccagcagcgtaaacctccggcccggctccttcttaatcataattttgagcatatttaaaagctcctgccggtttggcacatttgtcaggtaatcaacggaaatctgcttgttctgcagatgcagatatataataagaagagcgcaggttgcagccgagcctgacaggatcacctccgggtacatttcctggattataatgaccgctacggcaagaatcggaaaggccgccagaatccggtagatttttctgtctattctcttatagttcacaagagtgagggcgatcgatgcaaggcaataggcataaaaaataagataggtaaccgggataagcggccctctcgtatagccgtcactgcggtttatatcgaacagaagcctgttaaagggattggacaggacaataacggcgtaaaacgcaccgggaattatccccacggccattatcctttttacctgagggctttccgtataaataacagaaactgtatataaaaaataggccattcccatcagcggcgtcagcacaaaatacaccatggttactatccaggtaagccaaatgggcaccacccggtactgctgaatcataatcgttgacaggatattggtaaaaatggcgctgaaggtaaccgtcaggcaccactgaaaaatacggtttttcaaagtaggaagatggcttcctttccgggcatatacccctataatcccgatcatgaccaaagaaatggcttccgccgctatattccactccacgttattccccctgccagtccttccttctcccttttgcaaaaatcacgctgttacataatgtggtgcaaaagttaatgtttgactgctttgtaacattatacctaataatccggaaaaccacaatcaaaaccgccgtttcctgaaatttcctgaaatgttccgatagcaggaggacgcagctttattttcggggcataaactgactgccgcaaaagcagtttgtttccggcttttgcggcagtcctttaaggttccccgttatttacttaatctttttcacttaatcagtgatactgtcctgcatcaaaggcagcctgtttctcatccaggatttcctgatagccggcatccagataggactggctcatgctctcatacatggattcgaattcttcgtcggtagccgccttggtaacaagctggacataagactctttccagagttcagccaggtcggaggaatattccgccagagtatcaatcggtacggtaaagcaggtatccggtgtgaaatactcttcgtatttatcgttgtaagcaaggatatcctcgatcaggtattcataacctacaggagcattggagaatatgatggattttctccattcttcttctgtctcatactgcttgttggcatttaccagacaccagtagtcaccgttatcattattggacagcttttcttcccctgtatagccagtgggcgctttgatgccgtcttcggtcacttcataattctttccttcaaaaccattctgaagggtgtcaataacatcgggctggctcatccattccacatacatccatgctgcgattctttcttcatccgtcgcatccgcattgatgccgtaaatcatgccgaagggccagtattcacgtccctggggagcttcgcctgcaggggattttgccgcagggtcaaggatggcgatttctgcatccgggttctgtgcaagtaaaggatcaattacgttttcctgtgttcctgcattgatatagcaggggtaggtagcagcttttccagccacgaagttggatttggactggtttccatctgtatccagatagaagtcagggtcaattaaaccgttctggtattcataattcaggtttctcagatattccttggtgggttcccatgtgaaggaagcaactgcgaggtctgaattgagagctctgccctctgcatcgttgggccatcctctgaaattgtagtcaaagttaaaggatttagccaaaagaggctcggagccgaagccataaccggcttccttgaatttcagcagcatatcgttgtactcatcaagatttgtgggcatttcaattcccagttcatccatccagtcttttcttataagagttccgaagttggaagataccagctcggtcctgtctcccatgactaccatcagcttgtcgtcaatcacgccgtaatccttaatgatatcccccatggttccccagaaggtaggcgcataatatgcgatttcatccgcattcagttcctgataagcgccctgagcgtaataagccagaatattgggataatcgtaatggaaaatgaatgtgggagcggagcctgcggataaaagctgtgtgaagtcctgtacctccgtagaacgtccgatggaaacgaattccacatttacattgtatttatcaccaaaattttcctggatccatttcgtccagtagttatcggtaggattccagccttcccagcctctttcatataccggaacctgcagagtcactgcctcgggaaagccgccggagtaatcggtaaaatcggatgccgccgcttccggggtggtttctcccgcctcttctgtcttaacctcgggctgggattctgttgtcgctgtgcttgtttcactggaaccgcatcctgcgagagttccaagcgccattgctgaaacgagtcctgcagcaaggattttttgtaacgcttttttcatggttattcctcctaatataataatggtgtagtcaagaacgactactaagttaaaagttacaaagtccaatctaatcaatctatatagatataacggaaggaggagttctccctccatcagaagttataaggcaaccttatttaccttgcctgaggtttccttcatgcaccagacaaaagatagaggtataatcacggaaggcaggattatggacgtttcctccttgggaaccggccttttggctggtgaaacctctaaaaaagtctgtcagtccattcggtggtgatttatgttttggctggttgggatgccccaggctatacctgtataacccgctaggttgtgtatccaccttctggaattggatacctgccagaaaggatcaagttatgcactatcaaaaagttctcaagatgctggaaagcatcccctatctctctgtagggcttgatgtcggcgctgatttcacctggatgtccatcatgctcccaaatggcctcctcactggaaaaccctttaagatcatccactccgatccgcagtcccgtgagcttgctgtcacaaaaataaaggaagcacaagagacgtattctctcaaaagccgctgcttccttgagtccaccgggatctatcacatcccgctcctgtgcttccttcgtgataaggggtttgactgctccgtcattaatcctatcatcactaagaatagcacaaatatgaacgtaaggaaactgcataatgacaaatttgattcaaaaaaagcggctagagttggactggatgcttccctaaagacttccatcgttccggacgatgagatcatcgacctacggaacctggtccgtgattactattacttcaaagacctacagtcggcggtcgttctcaaactacatgcagaactgaaagtttccttccccgcttacctacaggtgttcagtaagatcaccacgcagacttccttaaaccttctatatgcataccctcttgccagggacatgcttgccgctccaaaggatgacatcatcaaaaccatccggagcacagcacgctttggggaaatgtatgcccttgccaggtatgacgccttatacactgccgcgaaagattccgaattgttcgggcgcgcccttcccagcaatgccctccggattaggctgtacatagattcttaccgggaataccaggggcatctggactccattctgcaagaactgcacaaggctgtagatagacttcaggggaatcctgcatataaccgcatccgtctcctacagtccctgcgcggcatcggctttttaagcgctgttgtcctaatcgcagaaatgggttcctttgacttatttccttcacccaagaagctctatgcttactttgggttggatcccggtgtaaatgattccggcaagctcaggggagacagggtccacatgtccaagcgggggtccggtcttgcgcgtcgtatcctgcatatgattgccataaacaacttaaaaatggagaaagggataaaaacacctgtaaacccggttatttatgactattacacccgcaaatgtgccagcaagaaaaagagggttgctgtcggagccgttatgcataaaatctgcaacatcattttcgctatgctgcgggataacaaaccttttgagatcattacacccgaagagcattgtaaacgctatgtgacagaacagtctgccaaaacagaaacagcagcttaaagatccaccactatgaaatttttaaattcccatatccgatgggtttattaaagtcgcctttttttacaccaactgctcaaaaaaactttttaaacatttttcactttatttcttgacatttcttagctggacttaattaatttataagcgaccgcttttgcggatacttccataatggtttcttaagttatcggtaagcctcagccttttaccgctcctatcatggtcccctgtacaaagtatttctgtacgaaaggatacacacagatgatcgggatggttgcaaatacgatacatgcggctttcaggatttccggatccgtcacggttgacatcgccgtatcatttacggagccctggatactttccgtcgccgcgacaatcaggtaatacagcttaagctgcaggggtctgagggacacattctgctttatatagaacatggcgtcgctgtaggtattccagcgtcccaccgcataaaacagggtcagggtagccataatcggcttggaaagaggaaggacaatctttcccagaatcgtgtaatgattcgctccgtctatgaccgcggattccacaaggctgtcagggattcccgattccagtgcatttttcatgatgacaaggttatatgcgctgaaggccagcgggagtatcagggccggaaggctttccagcattcccagcttgttaatcagtatgtaatcaggaatcattcctcctgaaaagtacatggtgaagataaacagcaggttaatcactttcctgccccgcagctcctttctggataagggataggccgcgcatatggtgatgaccatgccgagtgcggtaaaaagaaccgtcatcagtacggtgacaccgaaggatacgataaaggaattatcgtggaaaatctttatgtaagcctccggggtgaatcctttgggcagcaggaaaaccttttttgcaatgacaaagctttccgagctgaaggatttggcaattacatgaatatagggaagcacacaggtcaggctgaccagccctacaaatatatatatcagaatgtccaccgccagatttattcccctggatttcggcctgcttttcttagctgtttttacttgttccgccatttttccatcctccttataccagaccggtttcgccgagccgttttgcaacaaagtcggctccgagcaccagcgccagacctataatggactggaacagtcccagtgcggttgactggctgaacttcatatcctggataccccattggtaaacgagaaccggtatcgttgtggtatactcggttgccgcataattcatcagcgccataatacgttcgaaggaaccgcccataatcttgcccagctgcataatcagcaggatgacgatggtgcttcttatacagggaagcgttacgctccacatctgctgccaccggttggcgccgtccacacgggccgcttcgtacagctccgggcttaccgatgtgatggaagccaggtaaataatggttccccagcccatggactgccacgctccgataacgatataggttatcagccagctggtatcctcctgcaggaagtttaccgcatttcctcccaggttctgaatcagcgcattcacaacacccgtattcacggaaaacagctgataggcaagacctcctataattacccaggaaagaaagtgaggcaggtacaataatgtctgtgttacctttttaaatttaatattccggatttcattcagcagcagggccagaatgatgggcatcggaaagcttaccagcaggtccagcacattaagaagcaatgtgtttcttaaagacttcataaagttcctgtgatggaatactttagagaagatttccaatccggcccagtcccctccgaagaacccgtctttgattttccagtttttaaaagcgatctgcagccagctcataggtacatatttgaacaggaagcaaaatgcaatcggtatcagtaataaggaatataactgccaatctcttttaaaacaggaagcaaagctcctctgcttctttttcgcctgctttactgcaagcttgctatcagccgccacagctgattttctaccactcatatataatttccccttccttccgtcattgtgtttccgttttcttgcttcccagtatagcttttagccgtttttttgtaaattatcatttttgataggctgaatcatttttgagtgtgcccgaaaagccttgaaaacaaggcatttcaggattgtatttttttgtatacaatccgtttccatgagcttttatatggaaaccgcatttaattctgcccataaaagtagcaattccgaaggtgaaaatcaaaagtaaagtgtcattttgtatattggagcataaaaaaacctcttatccgccatcgttttgacgaacaagaggtttctcagcaaaatttccgtctactttttttcaaggtcacgcacgctgttgggtgttgtcccttcatattttttgaaaaaccggttcaggctctgtacattatgatagccaaccataccggcaatttcaggtattttaagatccgttgtcagaagaagcttcttggcttcatggatacgaaggcggttcacatagtccaccatgctgatatcaccgccctctttgaccaccctgcgcatataagaataactgattcctatctctcccgccgcctcttcatagtcaatatcctctttgtaatgctcatccagatacgcgatgatgcggtcatagagcttcacatcctctttttcttccgtcacctctcccagataatcctgtatctgccggataaaccctttcacaaacagctcgatttcctctatcgtatccttttccgctatcgtcgtataggcctgtcttccatttcccataaacttggatatctggatcttttcctccatcatcgccttgattatcgcccctatcatctgctgatagaccagcaccacattgtcataggaaatatcctctatgtcggaaagctgtttgcgtaccagctccagttccccgtaaaccgcctccgtattctgctgcttcaggtaattgatgattttattctcgcttgtatagggataataataccgtttgctctcgttcatcctgggattccagaagataacctggttcttgcccgctataatcctgtgctttaccgctgccgtcgcttccgccatgccttcattcaaatcattgatatccgcatggacggcacttatcccgattgtcagtgtataatcaaatatctgcctcacctgctgcttgacaagctctaacttgtccgtgatatattccgctgtctttctctgatcataggtctttatattcaggactaccgcacaggtcgtcgaacggaagcggatggacttcgcctcatatccttcctggctcaggcagtcggtaaacagctcttctatctgaaggaaataaaacatccgctcatctgaattatatttgcggagcatttcactgccgtcatccacgctcgccagcagtaccataaaatgctcataagggaacattttcgtaaagctttcctttttctctctggattccagtgtcccggtaagcatttctctcagatgaagccgctgggcatctgaatttttcttctccaggatgtcatggatctggctttcctccgacttcattttcttaaatacttcgttcagatagtacacttcatttttggagggggccttttccgtcatcccctccgtcatgttttcttttacattgttgaacagcatccggaagggtttgaatatccagtaagaaataagaaggaccaggaccatttccaccgcaatggcaaacatgataatcagcatcgccgtggatgtgaccgactttacctggcgcatgatttcatccatgctgtagtttaccacataggtccagttgttgaaggaggatctcttaaaggcgcacagataacggactccgtccttttcataatcgaaatagccggttctttgcttggaaccgaagatattttcaaggataagctggttttcttcccctcccaggaaaaaggcattatccggatggcatatgatattcctgtcttcatccaggatatagcagaccccagacgcctgattggagggattgatgaactcactcagcctggaattatagatattgcagacaatgtaaccgccctttgccgttatcagagggctgatggaatatacataggacaggaccggaattttgctccgcccctggctctctccaccgtcttttccgtcctggttattgtatagctcccgcgctatccactctcccctgattccggtttcactgacggctttgtccttcatccagtccagggacgcataattttccagcctgcagatgtttttgtccgaggaaatcacaaaatcgctgctctttcccacgtaaaaacaggactgtaccattttttccgtaccgaaaacgcggctcagataagactgggcgtcccaggctgtcctgaccatttcaaaatcaatattcagttcctggtaggaagtgacctgtcccaggtttctgtaggcagcgctgttggcaaactggattacattcctggtatagctgcttaatatcagttccgtggcatcgctgacagactccagattgtccagcttggataccgcaatgttatcctccgcatatttggccacatcctgcatggcgtaataagctatcagcgaggtcggaatgatcaggacacaaaaaatcatcagaaaaatctgccagaaaaaagaaaatcgcctcatgaatacccccgtaaatcttttctttctcttatactcacttatctttttatcgaaatccggctgctctcctccaggatttcctccctgtccacatatccttccagggatggatcgatttcatagattccttccacggtcaggccctccacgtaacgggtatacagccagggaatccgatgctcatacacatccctgtctgagggctgttcgtcaaacacccccggattatgcacactctgttttttccatgtaatgcggctgtcggtgatgcggatatcttcaataacggaatcctcttctcctgcaaggaacagggcggattccgaatacagcctgatatggtcaaaggttatcctgcggattttacccggatatttcttttcaccctttctgtaaccggcggaaaggaaaatcggttctccctttccccaccacctgggtgcaaaggttctgtttacgccgtcagcatatcttttggtatttccggtaatatgatggatctggatatcctcaatcgtccctccgtcacgcacccagattcccaccgcgcgggagcaatcccggactacacagtcgccgaatatcacgttccggatgtccccccaggtttccgttcctattttaagggccgaatcacgggaatgtaagatacagtttgtgatgactatattctcacagtttccgtatttctcccagaccggcctggtcgccttcaatacaatggaatcatccccgctttcaataatgcagttccggatgattacattccggcagccgtccggatcgattccgtcattgttcgggcccctgtcattattaaatatacggattccatccacaatgacattctggcagccggccatatgtaaagtccagaagcaggcgtcataaaaggtgatccctctaacctgcaggccgtccacatcctccagataggtcgtccgcgcccggaaaccggctacagccagagggcattcatggaagccctcatcagcgttatcatccagatataccttcctgccctgtccgtcaatggtcccctcacctgcaatcgtgatattccgggcatggcaggcatacaggaagcagccgttttcgatgccgtccatggcatccctgtcctctgaaaagtcaatgatgtcctcagggctgttgctggcagtcagcacgctccccttttccagatacaattccacattggatttcagctgaattgtcccggacaggaaattgcccgccggaacgagtacacgccctccggttttggcacagtcctctatggccgcctggatctgcttctgattgttggtttttccgtcaggcagtgcgccgtagtccataatattatactgcatatgtaatccctcccttttattgctataaataataaatatcaagtcttgtgaactatatgaccctatattcaactaaataaagtctggtatcaattaatgaccacagactttttaagcaattctatttattttcaattatctttaaagctcgtgtcacacctgcaactgaaacaatacataataacttctccagtaaagaacaaacctttttcttatccctaatttctttatatgccagataataaatatctgttatcgccgatgctgaaatataaccctctatcaccttgttggcggataagtcaatcactctggctgaattttcacaaaactgttctctgttcagaagcaaatccagaataatattcgtatcatacagtaccttaatatttagccagcctttcctcttttatatcttctaaagaaacatcaggcaaaggaatacttcctattaaagactgggttatttctgatatttcagacgaacctatacttgtagaagatatttcttttcgaggttcatctacaggcagcacaataatctctaattttctattttttaatgtttcaggcagctgcatgattttcaataaactacttgcgtcaacaatttttcgtacaaactccatattgcacctccttacgcccctttataacttctcttttatagtataatagaatttttcaccttatacaacctttattttgccgccactttttttcatctacacccttctccgcatactcaatagccatgtttggaatataacgtctatccgattacagacggcaagagcactgccatgcgacaaactgggtcatttctttttaacatggcagagggcatggttcagagcattgaggacgatgccagaacgttgaggggcctgaggaggaaggttattccagtatgattttggtacaggcttcgggcaggtaccagctgatggtgagttcattgtaggaaatgggatcggatgcatatacggcctgacgttttatcagatcgcctgcggcatcgtagaagcaggcgtaaaaggtgttaaggccggggaatttggtatctttctgcaggagatctcccgttactttcagattgtctatacctttgcttctttccagttctattccttttacggcaagggtggctccgtttttgccggtaagggtggtattgtagtatataagccggtcatcatatactgtaatcagggtatttccttctgttatcgtatacacctctcctttttccgccatgccgctatataccgcggcataggaaacgattgcgggattgcttacggcatatacggccacggacgcagtaccgaagccctgggcctgaatggtgagaactgcctgggaatttccggcatcgtggagggctgcctggataagagaaggatcggaaactgcaattcccaaatccgcatagccgcctttcagcttgctgtaatccacctggatggtcttcgtctcaccgattgacagacgggctgtggcttctttcagggctatgctctgtgcctccgccgccgccgtggggaaagggggaaaaagaaggaatgccgccagtaaaagtaatatagttcctattatatatgttccgatatgttctgataactgcattttttttgttctcatattcactcctgtcttcgtttcgggcgggcgggagccttcccgaaacgatatgatttcattttctgtttattggtaaccggtatggatgctattcgctccgcagggcatcgatggggttcagacggctggcttttctggcaggagcccagccgaatataatgcctactgcggcggagaatccgactcccagggttacggcggaggcggatatgacgaaatccgttccgagcaggttcgcagcggcataggatatgagcagtcccagcgccacgcctatcaatcctcctatcagggacagtacgatggattccagtaaaaactgcagctggatccgctccggcgttgctcccattgccttgcgcaggccgatttcctttgtccgttccgtcacggataccagcatcatgttcatgattccgatccctcctaccagaagggcgatggaggcaatccccgtcagcatatatgtcatcatgctcatcatactttccattgtgtccagcaggctgtccatgctgaatacgttatagcagtcttcattttcattgaaggccttgtacagtacgctttccaccgcctcctgcagttcctgtgtccggtcggtgtccgccacatatacatcaaggcttgtaatactgctgtttccggaaagcttcagcgcgttggtataggggatggtgacggttccgtccatggttcctcccattccggccatggaagccatcagattgctgtcttctccctgaagaccgattaccgtatagcggattcctcccacaataagctggctgccgaggggatcttctcctgcaaaaagattgtctgccaggtcctggtcaatgatgcatacataggattcattctccacatcctgtctggtgatgcctcttccataggaaatcagatcgttattcagaaaataggaatcatttttcccctgtacagacacctgttccagcagttttccgggtcgggcggctgtggtggtgatgcttacggatggagatatccccgacacgttatccagctgctcaatggaatccagatccgattccgtcagccccttcttcaatgaagacccggttatggatacggagagggttccggccccaagggatgagaattgccccataactgaaccgattaccccatccactatggttatcagggctataactgcggtaacgccgataataattcccagagtggtgagaaaggtacgcattttgttgctctttatattctgcagggacatctgaatgctctgcctgatgactgatatggtattatgcatcctccaaagctccttcccctatattaccgtccagaatacgcacgatacgccccgcatgttctgcgatatggatatcatgcgttatcataataatcgtcctgccttcttcattcagttcatgaaaaagctccatgacctgccttcccgtcttctgatccaatgctcctgtaggttcatccgccaaaaggatggaaggattgttgcacatggctctggcgatagccactctctgctgctggccgcctgacatctgattggggaaataggaaaccttatcccccagccccacacgttccagcatatgcagcgctttttcatcctgttccttatccggcaccccgccgtacatcagcggcatcttcacattttccagggctgtctgtctctgcatcaggaaaaaagactgaaaaataaagcctatctgcttattgcggatatgtgccagagtcttttcatcctgatcactgatttgtattccggacagcagatattctccttccgtaggtacatccagacagccgataatattcatcagtgtggatttccccgatccggagggaccgagaatggcgaggaattctccttttctcactgtcagatcaattcctttcagtacggtggaaatttcgccgcctacatggtactgcttcacaatgcctttcatggatacaagaatatcatccgtctgctccgaaacttctttccttacagctgcttccgtctgcgacatggctttctgtctcctttccatactgtttactccgccattacagggaagttccgtcccggtaatcccacgcccgcattcgaagagacggtcacttcctccataactgtttctcccagggaaaggccttccgttatctgcgtatatgtaccgtctgatattcccagcgtcactttccgtttctgcgccctgcctttttcatctttcacgtaaatgtatgcggtattatccacatcatacagtattgattttgccggaaggcatactgccttttccacttgtgcctttaccagcttcacctccgcgctgaagctgcttcgtatttcttcatccgtcctgaattccaccaccgcgtccacatagacggcattgttatcaatagtagctgttttggaaaggctggcaatccgtccttcataggttttatccagcgcattcacataaacggaaacctcatccccttcctttactcctgccacatcctgttcatctatttttaccgccacctgcatcatgctgaaatccgctatctcggcaatactcttcgttcctgtcgtggtgacatcccctgctttgatatccaggctggttaccacgccgtctatcggggcggttatgacataatcctccagggattccctgagatgctccagctccagcctggtgctttcttcgtccgccagagctgtcgtcttctccagattgttctcataggtttccagattctgtccggcagaaagggcatttgtttcatagtctctttctgccttagccagagtttcctccgctttatccatggcttccttataatcttccagctcctttccggctccttccacagccaggttataggattctctggcattttcataggcaatccggtaagtttccagcgcttcgtccgtaatcattttggcatcatgctgggccacggccgaatcataggaagcgctctgggactgaagtgtctggcgtgccgatactacggaagaattctttcccgcatccaaatcttctttggcctgattataggcatccaccgccgactgataatcctcctgtgccgccagcaggtttttctgtgccgaattcgtattggaatccagtccaccctccagcgcctggctgtaattatccagtgcagtcctgctgtcacgcacattatagtaatcgcttgtttcaccggctttcagggccgcctccttcagcgctatgctgtattccgcgtcggaagaatccaggacagccaggacgtcccccttctttacttcatctccctcttccaccttcacctccagcactttggccgatgcaaatgcgtagacagacgaatccgttaccgtttcaatatttcccgaaaactccagataagtactcaaattcctctcctccggttcaatttccctgtattttccagcggaagctcccgatacgacaggtaccagcagcataaggccaaccagaataatcgcggttaccggaattatcacttttttcttccctttccatttcttcataaataactccttgtctgcccgtttcagcgggcgcatcatccatctttttccggactctgccggacttcgtatatcatcataaaaaataaacctcaacaaagcttcaataatttcatcccgaaaagagttatttattgaagttttgttgaggttttgctgtataatggaaaggaagaagggagggaaccgatatgtttacaattctggttgtggaagacgatcgcgaactcagggagcttttctgtaccgtacttacggaaaacggataccgtccgctggaagccggtgacggtgaagaggctctgaaggttatggaaacagaatatgtggatctgattatttccgatatcatgatgccgcatatggatggctacgaactgaccaaagaaataagaagggcgaatatgaatcttccgattctgatgataactgcaaaggacagcagcttctataaaaaagagggatttcaggccggtaccgatgattatatggttaagcccgtagatgtaaacgaaatgatctggaggataaaagcgcttctgcggcgttctcaggccgcgcacgaaagaaagcttacggtgggaaccactttgctatactgtgactcctactgtgtcaagagggaggatgaggaaatcattctgcctcccaaagaattccagctcctgtataagcttctggcaacgcctaaccggacgttcacccgcatgcagctgatggatgaaatatggggactggaatccaatgccacgactcataccctggaggtgcatattggcaggctgcgtgaaagattccggaataatccggattttcagctggtcaccgtacatggactcggctataaggcggtgttattatgaaatcgaaaaaaacgacacttcgtccgaatctgatccttttattctgcgccgccgtatttctcatcaccacaggaagcatgcttcttatcggctccatttttgttctgttgatccatatgggtttctttatcagaccccggccctttttcctgtttttagccatcgccgtatccagcatactcatcagcaccttgatcgcacgggttatcggggaaaaaatatttgctccgattaaagaactgaatcatgcgaccaaacagatcgcggacggaaacttccgggtttccatcaaggaagacggcactgtggcagaagtccgggaaatggcccataatttcaaccgcatggcagaggaactgcgccgtacggaaatcatccacaatgatttcgcgcgcaatgtttcccatgagtttaaaacaccgctttcttccattgaaggatatgccactctcctgcagagtcccgggctgtcggaagaaaagcgtctggagtatgcttcccgtatcatcgccggaaccaaacggctcaccacaatgacagggaatatcctcatgctgtcccgcctggaaaaccagcagaccggaatagaacgatccgctttttccctggatgaacagctgcggcagatcgtcctgctctatgaagacgaatggaaccggaaggaactgtgcctggagctggatctgcctgccgtaacctacgttggaaatgaagaactgctgtttcaggtatggcagaatcttttcggcaatgcggtgaaattctccaatcccggaggttctgtttttctgcagctgctgccggaagaaaaacagattacggttctcctgcgcgatacaggcacaggaattgccgaaaaggatttgaaccggatttttgaaaagttctatcagggcgaacaatcccggaacacacccggaaatggcctgggactggctcttgccaaacagatcgcggaactgcacggcgggagcatcacagcgtcttcctccctccaagagggcacggaattcactgtaattcttcctgttttgacggaagctgatctgttggcttaaggcatattccatttctgcataaaggacatgccctccgctaccgccatttggaggaacggctgccaagatagacttctgccatatcaaaatcctttgagctataaaaggtattatcagcagagatccccatgtcttcaaaaaacccttcaatattggaatgaagctgtctgtcagattactttccttatatcggattgtgtcaagatttccgatagatactgtatggttcgtaaccgcaagtgaccgaatcggacatgcccataaaataagcggttgcagactctccgcccgcaaccgcttttccttaattccaatttacatcactgtcttttacatattccccgctgtcaattctctgttcagacgcttctaatctcttccgttcctcctgggttagtttcgtaaaatctggatcccacgcaagcacaagccgtcgaatgaattgacttgcaaattcctgttcgctctccggcagcatttccaacatctttactgattcctgtattgtctgtgtcattttaattcctccattcatttataaatatctccacggcttccaatgtccataactaaaagtatatctaattccccttcttgtgtatatcggtaaataactctgtactttcctactctcaacctatgcctgccgtccttgtatccctgcattaaccttatgtccccctttggcggctgttctgtcagtcctgcaattgcattccttatggaatcccttaattttgggggtagcccttgcagatatttcaaggctactttatcgtatcttatttccacttttttattttacatccctttcaataatataatttcattatatacttgtttaagtatatctattattcagcaatactttttaatccattctctcattcacctatatttattccctccctctccaatttttcatcaaccgccgctactattagtttactaaaatccccataatctaattttttcgctgcttccatatacttcggtttcttacctttcggtaacgtaagatgataatgatccagattttctttattccatttattttttgctgtggtagctgccgttcccatattttacatacctcgctttcctgcggttttaaactcttttttatattgtatcacacttccttttcttgaacaagtatacaataacatcatcaaacgaaagaggggtaaaagcttatgacaaacagtaaaactattgaaaacgctaaaatgcttcacggcattgaagaagaattacatacatttgccaaatggaaagaattaggatatatcccgcaaaaaggacagcatgccattataaaaaaggctatggaaatcagttactaaactgagtcaagagggaaaagaagaaacaaaaatgttcatgacaaccaccgcttttcaagggtatgccgcactcctgcaggatcccgggctgccagatttctgattttttacatatcccgtgacttcttcacgcaagccttcatcgcttcaaacaccgcgctgcgcattcccttttcctccagtacgcgtaccgcttcaatggtggtaccgccgggagaacataccatatccttcagctcgccggggtgctttccggtttccagtaccatttttgcgctgccgagcacagcctgcgcggcaaaggtataggcctgggccctgggcatgccgtccgctaccgcggcatccgccatcgcttcaatgaacatgaacacataggcaggggagcttccgctcaccgccgtaaccacatccatgagatgctcgccgataatttctgttttgctgaatccgctgcagatatcacggactgtctccatatcctcagccgttacgttttcgttgggacacatacccatcatgccttcctttaccatcgccggggtatttggcatggtgcgtatgattttcagcggcttttcgaattggtctgcaagccattccagtgttttgccgggcgcaatggtaacaaggatctgatccatgctcaccgtatccctgatttcttcaatcacactctggtaatactggggcttcaccgcaaggaaaagtacatcggcaaaggccgccgtctccttattatccttcgccgcaagaatccccatctcttcttttctcgcttccagcgctttttccagcgcatcggaagccatcagctcctgcggggtacatttcccggaatccaggatcccatgcatcatggctccccccatatttccgcatccgataaatccaattttcataattttccatcctttctgttgtatgtgtcaatgacagcgttgaggttcctttgggcgcatataaaaaagtgagtgccgtctgtggcagggggtcccatcccgcgggttctttcctgtgccgccgctgcggcccttcccgggggacgtctgccgggaagcgccgcagcggcggcacaggaaagaacccgcgggatgggaccccctgccacagacggcactcacttttttatatgcgcccaaaggaacccctccgccgtcaggaaaagctctgctccgtccgttcgatgatttcatcctgaagggctttgctcagattacggaaatggtcgctgtaaccggccaccctcacaatcaggtccttgtattcctccggattctgctgggccttaatcaaggtctgcctgtcgatcacattaaactggatatggtgtccgtccagattaaaataggttcggatcagattagccatctgattcagcccctcttccccttccaccacggacggcgtgaatttctgattgagaagcgtgccgccggtactgagatgatccattttggagcaggacttgatcaccgccgtaggcccattggtatccgctcctttttccggagaaatcccttcggacagcggcttatgtgcatggcggccattagctccggccaaacacacatctccgaagtacacatgacaggtggtgggaagcatattgatccgataggtccctccccggttgttccgtctcctggtcacgctcttataatagaaggaaaacacttcctccataatggaatccgcatattcatcatcgtttccgtatttgggcgtccggttggaaaccaggttatgtattttcccatagccttcaaaatcatttatcagcgcatccatcagttccttcatggtgaaccgggaatgatcgaacacattatatttcacggcggccagacagtccgtgatcgttccgatccccactccctggatatagctggtattgtatctcgccccgcccgtattataatcctttccccggctgatacagtcgttggtcagtacggaaaggaaaggtaccggcatttcctgtgcataaatcttttcaatgaccagatttcctcttattttaatatccaggaaataacgcatctgggtacagaaggcctcccacagctcctcatagcttttgaaatcatagccatatcctgtttccggccccagctgggcgccggacatattgtcatagccgttaaacagagccagctccagtattttgggaatgttgaaataaccggtaaggatataggcctcgttgccgaaggctcccgtctccacacagccgctggttcctccctttctggcatcctcgatgctctttcccgcattcagcagttcctggacaatagcctccgtattataaaaggcaggctgtccccagccctttctggatatttcacaggccttcttcagaaaatcctgaggcgttttcctgctgatctgcacattggaacttggctgaagcagcttcatttcatccatacattccagaatcagatagctgacctcgttcacgccgtccttcccgtccggcgtaatgccgcccgtattgatgttggcaaaatccgtataggtactgctttcctttaaggtgattcccaccttgggcggagcaggctggttattaaacttgatccacagacattccagaagctccttcgccttgtcatcatccagccgcccctcttccacgtccttcctgtaaaaatggatcagatgctgatccagccttcccggactgtaggcgtcccagggattcagttctgtggtcactcccagatggacaaaccagtacatctgaatcgcctgccaataggttgcaggacgatgggccggcaccatacggcagttttccgcaatctgcagaagctccgccctgcgcccctcatccccgcattcatccgccagcttctccgccagctgcgcataacgggatgccagaagcataatggcatcacaggcaatggacatgccctttaactcggcttccttatcaagcgcctccggatcgttcagataatccagccgttccagctccctgccgatatcctctttatattccaggaaccctttccggtatatattttccgaccccaccgtatggcccgggcctctctgctccatgaattccgtaaatatacccgcccggtaagctgccttccactcaggcgtcatatgcgaaagaatcttatggcggattgaacggttttcccaataagggatcatttcctgctgctggaacgtaatatcctcttccgtcacccggaagctgatcaattcccggtcattcatcactcttaaatcttccgccgtatgacagcacagatccggaaaagtgggagacgcctggggaccgcagcccttttctccaacaatcagctctccctccccgatctgtatggttttcttttcgaaataatttttcagggcaagcgccctcaattccggtatgctgaccgtcccctcatactgccggtaggtttccgtaaaataccttgcccgttccatatcgatacgcggcaaagtctccaggctctcccgcctaagcttgcgtatccgcgcgttcataccccgttcttccatttccggatatccttcctttctctgttatcgccgcctgtttcctcatcctccgataaaaacaggcgcaatattctttctctccatcagccgctgcagctcctgcatacgttccttcggcggcgcataaaacatcccgccttgatattcccgattcagatgcccatatttcccgcttcccgtattatgataaggaataaggtttatctgctccgcacgtacattttccgaaaggaaccctgccatccgctccagttcttcttcctcatcattcacccctccgataaccggaatccggatccatatccgcgctccctttccggacagaagcttcagattttccaatatcagcttattatcccttcccgtatactccctgtgcttatcctcatccaaaagcttcaaatcaaacagaaacctgtccgtaaaaggcatcacccgctccagccgctcaaacgcgactgcaccgcaggtatccacatttaaggaaatcccccgcctgcaaagcgtccccatcagcttttccagataatccatatcctgggcaagcggctctcctccggacagcgtaacccctccccccgaagtttcataaaacgcccgatccttcaaaagctcctccgtcaattcacccacagtatagcttcttccgcacagctgccgcgcattccgcatacacccatccacgcactccccacaccctgcgcagagttccctgtccgtaaaagccttcccatccgccgctgtgacagccccattcctgcactccttcacacactccccgcagccggtacaacgctcttcataaaaaataagttccttcccataaacctgcgtctccggattatgacaccacctgcaggccagcggacatcccttaaaaaacacagtcgtacggattccccttccgtcatgaatcgcatatttctgtatattcgtaatcaaaggcaattccatttttattcatccccataaaaccgtcataacaggcgcagaagcttttccccgcccatagggaaattataatcccggagacatataaagccaagtatttttcttttgaaaacggaatgatttcatcctgttcattgaccctgccgcagccacatgctaaacttttcataaaagctgctgtccatccttaccaaccacttgtttcaggaggatgccctccgggcatgaaagatatttatggaaaaatatataatagagcggatcataaacatcatacactgcgaaatacggctggctgatgataccggacatctgctggatcgattcggaaatctaccggaaaacgaggatcctttctgtacggatccttcttttctgcgcgcctgcctggacagggaagcgctgtccctgccggatattttctgtgaaaatacctatatctattatgccaggctgagccttcccgacaggacgagcctgctggccggtcctgtacgtattatccgggaatcccatgatatggcttcccaaatggctgccgcacacgggattcaggtatcgccgctgaagctgcccttctgtgaggagaatacctttctgaacggaatccttctcctgtatcactccgtaacgggcagggaaatcagcatgacggaattgtgcagctatcacggttttcctgcagatgagcttgatctggcaaggaaagagctcaacagccttgttttttccacccgggaatctgaaattccgcataatccttacagccatgaggcaagaaaattaaaaagcatagaggacggcagcccggaacaactgaaaaaatgtcaggaagaggtctgggtgggcaggctgggaaaggtggccgacacgcctttgaggcaggagaaaaacatcgccatcatcgtgattgtcttagcctccagagccgcgatccgcggaggtctgctgccggaactggccttttccatggccgacagcttcattatccgtgcggaacggatgaacgacatcctgcagatccgctccgccgcccgccggttcgaggaagagtttgccgtaagtgtccgggcactgcaaaaatccaacagcaaaaataaatatgtggatctggcaaaggaatatgtctaccggcatctccattccagcatcggcatagaggaaatcagccgttatgtaggcttgcataaggactatctttcccagctgttcagccgctgcgagggcatcaccctgcagcattacatacggagggaaaaagtacgccaggcagaatatatgctgaaatattccgatgctaaaatggatgaaatcgcaaaccagctggccttctgctcccaaagtcatttcagccattgttttaaagaagaaatcggacagacacccagccagtacagaaatcaattttccgggatctgagatatacgacaaaaataccatatttgttatatactattttcttcttccgtgctatttattaagatagacatgtattatgttttagtggtacccctttaaacaagataccgcaaacggcaaaaggaggatgatacgaatatggcaatatccattcaggtaaatgaaaaaagaataaagggccagagaagccccatgctgtacggccatttcatcgagcattttcacagacagatttataacggaatatacgatccgcagaaccctttatccgatgaagacgggctgcgcggcgacatattatcagccatgcggcagataaaggtgcctgttctgcgctggccgggcggctgttttgtatcctcctaccactggaaggacggagtcgggaaaaaccgtcagcccttctttgacaaggcatggcgcgtggaggatcccaacaccttcggcacggatgaatacatcaaaatgtgcaggaaaattggctgtaagccttatatctgcaccaatgccgggacgggaaccgcggaagaaatgagcgactgggtggaatactgcaacctggaatccgaagggaaatacgccaaatggcgcatcgaaaacggcagtccgcggccttacggggtaaaatactggagtatcgggaacgagaactacggcttctgggaaatcggcgccaaatctgccgacgaatggggaaggcttgtaaaggaatccgccaagatgatgaagcatgtggatccccgggccgaattatccgccgctgccctctccgatttggactggaatattaatctgctgaaaaactgcggacagttcctggactggatatccattcacgaatactgggatatgatggcggaaaaaaatgagccagccacctacgagcaatgtatggcctataccgaccatatcgatcattccgtggacgaggtgagaggcatgctggccgccatgaagctggataaaaagatccgcatcgcctttgatgaatggaacttaagaagctggcaccaccccaatgtacataccgtccggcagggtaccggaaaagaggactatattacccccagggacaaaaacgatgacaacagcatgtataccatggcagacgccgtattcacagcctgcttcttaagcgccatgaaccggaactgcgatatcgtggggatggccaacttcgcgcccatactgaataccagaggatgcatttacagctatccggagggcattgtccttcgcagcacctatcatgtgtttgatttatatgtaaattacctgggcgatattgttgtggatctgtggacgcctgattctgtcccctgtatgcatgtcaccggcaaaaacgggcaggaaactgacgtggaaaccctggatttgctcgccaccacctggtcggaccgcccgggaaccgcccttgcggccgtcaacaagcatccttccgacagtgcagctatccgtctgtccacggctttcgaaggtatgaacgttgtgatttaccggctgaacggaagcagcccggattcctataatgatgtgaacaggactgaggtttccatccgcaaggaagaacttggcatgttccgtgagaatatggaaatctctgtggaaccgcattctgtaaatgtgatacagctggtgccttaaagttttagtcgcaaattcattttttatcaatgagctgacaatggccggggctttcctctaactgaggatgccccggccattactgtttaaagctgcagcgccgaaaacgcgcagcttatttccccaggataaaatgtaccacgccgcagtcatactgggcccagacaccatgtctcgcttcatccccggaacgaaccctgtccgtcacaaattttccctcttcgaaatgcccttcctccagacacaggaattccatgctgtgcgccaaatgctgcccgttcatccagctgacagggatagaaccgtcttccggctcttctccggtaaaaaacagcctcaccttatgtcccaccagataaaattcatcctcgctcatccggaacagcagccctcttgccgtttcctcgttaaggcttacaggcacccggaacgcatccccgctgctttccttaccatgatgatagtcgaacggcacccagccggcatagtccgcgcccactcccgcataggaaatccggcacctgcgccgtccgatttccataaacgcggagtcctgccccatactctggaagaagctgtaacgctcctgtacgccgcttcccggcagaagcagaccggacgccgctgtgagcatggcgaaagaatgcatgactggctccgcggattccttcagctttccatccgaatccagacagctttctatcccgaaaacatgatagcctatggcgttatgccttcccacggcatcaaacatacaggccgcattcacactggtcagaccggattccggtacatagagcggccagccctgctcttccttttcatatatcccataagcttttcttaccgcatccggattctgttcgtagatatcagggcagacggcatccagatggccgcaggcgcaatgccataacggaaggcatttggaaaccgcgccgccgcaggggtattccagtccggccaggttccagccgtaatcactgttgcgatccatccatacattggtatacatgaaaatatcgtagatttctttccctccggccgctatttcatcaatatatctggctacggcccacgccgaacacaattcagcaccaaaggaaccgaacatttccctccagttcccctgttccctgctgccgtttttcacccagctttgatggatggctccgcaatccgtccgtgcaagctgtctgatcccatccggcacctgcgcctcaaaggcttcggttcccgcctcactgaaatcacgccttgtgggagcatagaaaccgggctcattttccacctgaacggcaagaatggttccctgtttcccatcatattctctgagaatctccatgaacgcacggaacgctttggcatcctgctccagattcctgcggctgtggggagaaagcaccgttgtctgtgttccgtccttacaaagcacccggggaaaacgttcccgatccttttttacccaggacggcgtatattccatctgcccgtttttccaggttccgaaccagagcagagtcccgtgcaggccgtggcggcgtatgttatctatcaccgtatgcacatagccggcattataggccccctcctccggttcaaaggcatcccagcagatcggcaccgcaatggtattgccgccgattgccttaacgctctcaaaggatcgttcactgtcctcttcatactgcgggttcccttttctcccgatgggataggccgaggaattatgtacctgccctccgatggaaaaaaacggctttcccaagactgataaataggaatgacgcatatgttaccctcccttaaacacctccggcagccggtttttttactctttcgctgccttgatcctgtcaagcacatcctgaatatccttcgcgatcaggctgtgcatagtttctttgtatttcatataattcaaatcagatactgcttcttttaccgtttctcttaattccggcttatacgtcacgatttccgccagcgccgcaagggcctgtctgactgcagtcggcttttcatccttcagaatgagcagcacctcgtcgatattttcatcgaggatgtaatccttatcccatctggcctgcctgcagaaaagccggaagccgcggaccctgagcacatatttatcgctctttatcatatccgcgaattctgcggtatgtccatataacgcccctgtttcgtccgatatcctctccagctcctgcaaagccttgtatgctgccgaagtatccttttctttgagaatggaaataagcttctctatgtcggatactgttattccgacggcattcttcgaatcctccggtgttgccgctgtttccggttcgtttttgtcctgaatcatttttcctcctagtataataatggtgtagtcaagaacgactactaagttaaaagttacaaagtccaatctaatcaatctatatagatataacggaaggaggagttctccctccatcagaagttataaggcaaccttatttaccttgcctgaggtttccttcatgcaccagacaaaagatagaggtataatcacggaaggcaggattatggacgtttcctccttgggaaccggccttttggctggtgaaacctctaaaaaagtctgtcagtccattcggtggtgatttatgttttggctggttgggatgccccaggctatacctgtataacccgctaggttgtgtatccaccttctggaattggatacctgccagaaaggatcaagttatgcactatcaaaaagttctcaagatgctggaaagcatcccctatctctctgtagggcttgatgtcggcgctgatttcacctggatgtccatcatgctcccaaatggcctcctcactggaaaaccctttaagatcatccactccgatccgcagtcccgtgagcttgctgtcacaaaaataaaggaagcacaagagacgtattctctcaaaagccgctgcttccttgagtccaccgggatctatcacatcccgctcctgtgcttccttcgtgataaggggtttgactgctccgtcattaatcctatcatcactaagaatagcacaaatatgaacgtaaggaaactgcataatgacaaatttgattcaaaaaaagcggctagagttggactggatgcttccctaaagacttccatcgttccggacgatgagatcatcgacctacggaacctggtccgtgattactattacttcaaagacctacagtcggcggtcgttctcaaactacatgcagaactgaaagtttccttccccgcttacctacaggtgttcagtaagatcaccacgcagacttccttaaaccttctatatgcataccctcttgccagggacatgcttgccgctccaaaggatgacatcatcaaaaccatccggagcacagcacgctttggggaaatgtatgcccttgccaggtatgacgccttatacactgccgcgaaagattccgaattgttcgggcgcgcccttcccagcaatgccctccggattaggctgtacatagattcttaccgggaataccaggggcatctggactccattctgcaagaactgcacaaggctgtagatagacttcaggggaatcctgcatataaccgcatccgtctcctacagtccctgcgcggcatcggctttttaagcgctgttgtcctaatcgcagaaatgggttcctttgacttatttccttcacccaagaagctctatgcttactttgggttggatcccggtgtaaatgattccggcaagctcaggggagacagggtccacatgtccaagcgggggtccggtcttgcgcgtcgtatcctgcatatgattgccataaacaacttaaaaatggagaaagggataaaaacacctgtaaacccggttatttatgactattacacccgcaaatgtgccagcaagaaaaagagggttgctgtcggagccgttatgcataaaatctgcaacatcattttcgctatgctgcgggataacaaaccttttgagatcattacacccgaagagcattgtaaacgctatgtgacagaacagtctgccaaaacagaaacagcagcttaaagatccaccactatgaaatttttaaattcccatatccgatgggtttattaaagtcgcctttttttacaccaactgctcaaaaaaactttttaaacatttttcactttatttcttgacatttcttagctggacttatgtaatagtgtgttatccacaggaatcatctacttacttgattctaaatcctgcagaccatcaacggccagctgtgcataaagtgcacagccatatttcaggccggcttcatcaattaaaaacttaccgctgtgactgggattctgaccattggatcccatagaaataaataccccgggaacacgagacgtatactcagaaaaatcctcacttcccataaaaggctctatcgtctgaagcggctttcccaataatttttccgcgctgtgtgcggttaaatcgaccagatgatcatcattcagcaatacctctgtccctttctgataatcaataactgccctgcaccgataagcctctgccgttttctgaaccagccgttctaccgttttctgcagctgcagatgcatttgcttatcataacatcttaccgtcccttctaaaaccgcttctcccgccaccacattatggcttccgtcagaacagaaggaaccgacagaaataaccagggggtcaaatgcattaaactcgcgatgaatatctgcgttgagcgtcataacaatagcggctccggctaacgtcgcgtcaatcccggtatgcggaaaagcgccatgacacttttcacctgcaatcaatattttgaaggtatccgatgcagcgaacatagcacctttccgggtcgaagccactccaagttcatgtcccccaatatgaattccaaaaatactgtcaaccccatccaggcccccctgctccactactgttctcgctccctgccctatttcctccgcaggttgaaaaatgagtctgaccgttcctttcagtaaattacgatttttctgcagtaattcggcagcgccaatcagcattgccacatgtgtgtcatgaccgcatgcgtgcataaccccttcctttttactctgaaacggcagcccggtttcctccataatgggcagtgcatccatatccgcccgcagcgccactgtttttcctgtcttttcaccggttatctccgcaatgattcctgtcggtaacaggcgacgacaggaaatacccagcgtattcaattcacttacgatccgatccgtagttgcgtattctttaaaccccagttccggattctgatggatatcccgacgaatcctgataattttttcttcaatattttctgcctgttccaaaaaattcatagctggttccagtcctttccgaactaattctgcagcatcatctgtaaaatctcattgtctgccgctcttaggccaactcttccaagccttgcgatattttttaccgtagtatccacattattggtaatcagcccttccccaggcaggaatttctgtccttcacggtacatttccagtgcgaaaatccccgagtcaacagcagcggcaattttggccgcacaggatgattttgccccgtcacatatcattcccggaagaacaccgcaggcatttgaaatcgtatatgcaatttcttcttcacgcccgccggtcaagtacgaaattccacatgccgcaccaatacctgcacaaagcgcaccacaaaaagcagaaagctttccaattccctttttcagataaatcgccaccaagtccgagacaataacagcccggataagtttttcccttgattgtttcagttcattggcatattccgccaccggtacaacggcggtaattccctgattaccgcttccacatagtacaaccacaggcttaaccgagccgctcatacgtgcatccgaacctgctgtagcttttgcccttgctcgcacccggacatcatttttatcatattgtgacaacagcgttttcccgacatttgccccacaattttcctgaagtcctatttcggcaatctgcgtattataatcaatctgcctggaaatcatttcttctatctttaacaattctacctgatcggcaaaacaaactattttaggtattgtgatttggaacagggctttttcatcgtcatttccgttttcattcccatctttttgataaagcacttttccattcttttccatataaataaagtttgtatgttcatctgcaatgattacgctggcatgttctttacctgaaatgacctccgtgcagatttcaaatacccttccgctgtctgaaagttcaacctccacagtatgatgttccaaataatcagcaattgcttttctctgcacatccgatacgtcctttaatatctccagacttttctgtgtattgccgacaataatgccggcggcggcagcagcctgaataccaatcattcctccggtattcggtacaataacgctttttgcgttttttacgatatttccactcacccgaactgttattttatccggaatacaacccaatatttccgtagcttttgcagcagataacgcgattgcaatcggttctgtacatccaaccgccggtatcagctcttcttttaaaattctgataaaagcttcaaaataaactttcattattattctactttccactgctcgtatttccagtttttcaagccaaatgggcttgtatctacgttggaaatccgtttgttataaacaaatgtctgcattttatagtacaaataaatcatcgggctttcttccatctgccatttctgaatctgttcgctaagctgatactgttcctcaaatgtcagggaagtcttaatgtttttgtacgcttcatcatatttcggatctgtcatctgattccagccatcaatccaataataaaaatgttcattattcggatcgaatggcgtcccagcagaacccataagtgcaaaatcacattcgtttccgttcaatgcggcactgatcgtagccatatccgcctggattacttccagtttaattcctgcctgctggaattgctgctgcaatacggtacaggcagtaacacgggcctgctggtcggactgaacatggaccgtataggttttgttaaaatcaaatcctgcatccttcagcatctgaacgcctttttccaaatcatattcatatgccatatcttctatcgcaggcgaatagaatggatggccctgttccttattgaacatagcaagggccggttttgcgtattctccgaatgcccctttggcaatcatgttcttgtcaatgatataattgagcgccactctttgttcctgagtgaatttcttattattaatcaacagatgatcatgtgcaaaaccttcgcagaccaccacctccagattcggatcttcttttgccatttcaaagtcattggaagataatacattggaataaagcaggatatcaacatccccggatttcaaagcggacagcatcgcggaagatgacaccacttttactatcaaacgatcaaagtccggagctcccagataataatcttcatttgctacatattcaaaacgttctccatcaatatagctgtcaaatttaaacgggccatttcctaccggatttcgccagaactcagcggattccagttcttcgaacggtatatccttcaacagatgagatggcataatataagtacgatagtagcttttcatgaaaagttccagattcataggcgaactcaatgtgaattctactgttttatcatctatcgccttgattccgactttatcaaagctttccaggcaaattgaggtagtaggatcgactcctgcaaggctgtaaaaattcctttcaccactccaatcagggttggtaacaacagaagccgtccagataacgtcttccgccgttacaggagtcccatcatgccagttcgcttccggatggattttaactgtaacaacagtgttatcatcattgatgctccaactggaaaacaggcgaggttccagttctccggttccgctgattgtaatacattgatcatacataggtgtggtaaatgcctgctgtacgtcttttgtcggccacataaactggcacatggacatccatggactaattacacccgcggtaacaactttttctgctcccgctttttcctccttcacttcttctgtttctgtcttttgcacagcagcatctgttccatctgcactcttgccgtttggtgccgagccacagcctgctatgagacttacaagcaaacacaatactaaaataatactactctttttcttcatccttttattcctttcccctgatattcaatttcaacactattttctcaaaaaccgtatgtacactcacgatatgtactcctttgcaatcgtctccctccttcccccatttaatcataccgcgagattctttttccctttaaatctaatcatataaatgacaggctgcctgatgtcctataccacaatctttcagtgtcggacattcctttcggcagcgttctgtcgcataccggcagcggttatgaaaccgacatccggtcggcggaaaaatggggctgggaatatctcccgtcagaataatcctttctctcttactcccaacatccggtatcggaattgcggagattaaggcctgtgtatatgggtgcagcggttcttcatagagcctgtccacatctgaaatttcaactatctgtcccaagtacatgaccgcaatccgattgcttatatgttttacgacactgaggtcatgagaaataaacagatatgccacaccaaactcattttgaatatcccgcatcaggtttaatatctgcgaacggatagaaacatccagcgcggataccggctcatcacaaacaataaacccgggattggagatcagcgctcttgcaatcacaattcgctgcctttgtccaccggaaaattcgtgtggatatctgtacagatattttgagtccaatccgacaacggacattatttcctttacacgctgttcccgttcctctttactccctgtattaaaaacatccagcggcgcttttactgaatccataatcgtcattctcggattcagagaagaatatggattctgaaaaaccatctgcatctttttgcgcatttgacggagttcctcaccctttaaggcctgcatcgaagtcccattatattctaccgttccgccagtcggttcaatcaggcgcagtatacatcttccaagtgtagatttcccgcagccgctctctcctaccagtccaagagtttcaccgcttttaatttcaaatgacgtattatctactgctttcagaaaaacattgcgctttattctgaaagtcttggtcaggttttccacttttaccaatgtattgtcatttcccataccatcactcccctaccgtgttttcatatttccaacagtttacctgatggttttcaccatacatatctgaaatggtatacataggaggaatttcttctttacatttttcagttgcttcctggcatctggaacaaaatctgcaccccttcatccccttatgaagctttggaaccgtcccggtaattgaatacaaacgctccacctgcctgtccaatcggggaatggaatcaagcagtcctctggtataaggatgaagcggatttctgaaaatctgataactgttgccgaactccatagtatttccggcatacattaccataaccgtatctgcaatatccgcaactacccccaaatcatgggtaatcataataatggaagtatcaatttcatccttgagtttgagcatcaaatccagaatttgtgcctggatagtcacatccagcgctgttgtcggctcatccgcaatcagaaccttcgggttacaggaaagtgccatcgcaatcattattctctggcgcataccaccggacagttcatgtggatattcatgaaatctctcataaggcgaagggattcccaccttttccaataaggaaactgcccgtttctttgcttcttttttatcgacccccatatgtctgcttattgtttccgtcaattgctttccaatcgtaaataccggattcagtgacgtcatgggatcctggaaaatcattgctatatcttttcctctgatatcacaaagctctttatcccccagcgttgttaattcctttccctgcagcttgatggaacttccttccataatccgccccgaattttttggtatcagatttaaaatagaaaggctggttacggatttcccacagccgctctcccctacaatgcagaacacttctttttcatgcacatcaaagctaatgccgtcaacggcgggaacaataccctctttgccgtcaaaataggttcgtaaattctttaccgataaaaccacatttttactcatattaacccctcatcagactttcatttttggatccagtgcatcccgcaaaccatctccgataaaattgatagacagtaccgtgactaccagacacaagcctgccggcatccacatccaccaattatttgtcaacacactcaacgattgagccgcatacaccatgtttccccacgaagcctgcggaggctgaatcccgacacccagaaagcttaacgatgattccgtaacgattgccccggcaacgcttccgctgaacgccaccaaaagaggtgccactgaattgggcagaatatccttgaaaatgattctggatgtcttcgttccgattgctttggccgcttccacatattcattttccttgacggaaataacccgcccatatgccaatctgcagaatccgggccagcccaacagtccgattactacaataacagtccatgcgctcgatcccaccatcgcaacaataaacattgccgcaatcatcataggaatcgccataaatatatcggtaatccggaggataaccggccgaacggcattttccatatatccggccagaagccccagcgggattccgatcaaagctgaaataatcgctgatgaaataccaatcagcagtgacattcttccgccttccaacaaacgtgcaaacacgtttcgtcctacttcgtcggttcccaacagcattcccccgccaggagccgcatagaaggaaggtgtaatcatgttgggatccagctttaaaaatacaggcaatacaatgaccaaaataatttctgacaatataataacagttgctgtcattgccagtttatgcctggtaaagttcctggcgacatctctccaatgtgaatctttccgaacatccatattttttttattctgaaatagcacagccccacactccccattacgtatttttatgtatatcagacgcgtactctcggatcaatcaatccataaataatatcaactaacagatttaccagcataatgccaatcgtaatatatagcgttatccccattatcgccggataatccctaaatttgatggatgtcattaataacgtccccattcccggccatccgaagagctgttcggtaacgatagcgccgccaaccagcgtagtaaccgtcaatccggcagaagtaacgataggtatcaacgcatttcgaaatgcatgcttcagcagaataacgtttcttttcattccctttgccctggaaaccaaaatgtaatcttctcccaaaacttctaacatcgcgctgcgtgtctgccggatattggaaccagacaacgtaaccgccaggaccagaaccggctgtatcatatgccggaggatatctcccaaatccgctgccgccgcattggtatacatccccgaattgggcagaattcccagccgcaccgaaaataggtaaatagatattaatcccaggaaaaatgcaggcattcctgatcccaaaaacgccatcccggaagcgacataatcaattacgctgtatggcttccaggccgccagtactcccagagttgtactgataagaagagaaaccgcaagagcaagacctgccaataataatgtcggtccgatccgctctccaatcatttcagcaacgggctggccggaacggaaggaatttcccaagtcaccttgcagcgtggaaaccagccaattccaataccgaatcggcagcggttcatttaatccaaatttttcagttaattttgcaatctgttccggtgttgttgattcatttatataggcatccaccggagttcccggaatcaggctggaaagcagaaaaatgatcaatgatacacccagcagaataggaatcataaataaaattctctttccgatatactttaacgtctttatcatattacaccccacctatcctcgtacttgttcataaaccaaatcaatagcacgggcaattcctatgctctcattcaatggcataatcgggctttctttttttcccatcctgatacagtcctctgcatgttctatttcaaactgcagtcccggctcttcatacaaaagtgaaattctcttttcttctcccccacacggtttgataatagcggtatccggatggataaattcaggtatcacaactgttcccttttcaaacgcgatatttgccatacactgagactcaccttgaaagcccgtataaatctctgccgtacaatctttcgggaaacgaaacagagctgccgtacgaagatcaacctcatttttcatttgagcaattgccttaatttcatcagggagacatccaaataccatacaggcatatgccagaggatatattccggcgcttcgcatgcatcctccgcccagatcacgccggaagaatcgataatctttatcataaggatactcaaaggagaaatccgcattaacatttaccggctttccaaactcttccgatcgtataaattccatcagccacttgttgattgggaaaaaacgagtccacattgcctccataagaaaaaccttattttttctcgccgcatatactaacgcctcggtctcctcaaaagacatcgccattggtttttcacacaacacatgttttccatgttccagtgcactcatagtatgttcaaaatgtacaatatgaggtgttgccagatatataaccgatacactgctttgtttgtacagctgttcataatctgtatatctctctttgatattccatttgtcgcaaaaggcatccagcttttctctgttccgtccgtaagctgccaagactttcacatcaggaatatgctgaattgccttcataaagacatttgcaatgttccctactccaactacagcccaattcatataattcacctccattacagcataagctgctttcatccgatgcaaatgttccttactgttttattccctgtatcctctccttatctttccaatggcattaaatccggtctcttgcagcaggtttccagcgtgatttcacggtgctcatcactgctggtatgaatcttttccataatttccaggacatgcagtgccagctttccgcttgcacgatgattggttcttctctcctgaatacattttgccatatcagccagcccgattccgcggctgtcttcactttcttccgtgagcagcggataacgcctgaattcctcgtcaaaatattgcttcagcagaatctctcctccgaaaaaattcggatcaggtactattaaacttcctctcgttccatgaatctcaatcctgggcagggaagacccccatatatcaaaagaggtcacaatatttcccaccgccccgtttgaaaagcgaagaagcgcgctcacatgcgtaggaacttccacatcaatgatctgaccatatttcggctgactggtgatacggcgtacagcggcacaggatgtattcataccaaacacactctttatacttcccacaagattaatcagagcggtcaaataataaggacccatatcaaacatcgggcctcctccagctttataaaaaaactcaggattaggatgccaattctcactcccgtgacaaaccataaaagcttccgcactaaatacatttcccagcagcccttcatcaattattctgcggcaggtttgaattcctgcacctaagaaagtatcgggcgcacaaccaataagcaatcctttttcctccgccaattctactaacttctttccttcctcaaatttttgagataacggtttttccacataaacatgttttcctgcttccagcgcatgtttactgagttcataatggaagagcggtggtgtcaaattaagtactatatcaacttcaggatctgcaatgatttcctcaaaggtcatagtcttttcgatcttatacttgtctgactttattttggtattctcttcattcaaatcggagatggcatatacctgcagatgaggatgacttgttgtcagattcttcaaatagatatcgctgatgtttccacagcctgcaattgcaacattgatttttttcatgccgttttctctccccgtattaatctgatagtttaaaaagttttttgctctatgtagaatattatatacatatcttatggtttttctttacccgagcggcctatcattatacaaaaacagctttttaagatgttaaatattactttcttctgctaaatcatgttataatatactatattagtgtagaaaggaatattagtatatggcaatttattacaatcatctgctgcaggcggatcggaataaatatgaatcaatattctatactataggtgtcattgaaactgcctcacatatacatcatgaagcagaaatggctatggtacagcagggacggttaaaaataactattgatgatgtttcctattccgtttcagaaggcggaatgtttttcgtcaatcctatgtccgtccattcctttgaagcggaagctccgtatgccattctcacttttttaggatttaaatataattttttcaagaacttgttcccatcaacccaagatcataaaatttctttttttgtgcctgactactcggtgactacacctctgattgacaaaatccgtacattaatgttcactatttacaagaacttcatttttgatgatgaaaggcacaatattgccgcacattcagccgctttattaatatcattaatccttcgggataatttttcttcaaaaagtgaatcgatcgatgcaaacgaaaccatgcaaaacaaccgaaacttcagaattacggaatatatcagcaataacttcgataaagatattaatatccattcactggctgagcatatacatctttccagttcttatatttcccattattttaaggacacctttaaagtttcttttaatcaatatttaactacctttcgtattttaaatgcaaagtatctgctgtcagccactaatcttccgataactgaaattgcttttcaatgtggatttgacagcagtactgacttttcccgcgtatttaaaaaatttgagggaattacgccgtccgcacatcgtaaactccggttcaacaatacctttttcagtccaaatgacagtggaaatgtttatacgacccgcagtggtttttatgttgcattttctccgaagcagcatgtaaaactacttcaggaattcttaaaaaaagcttcaataaatcaagaggtcttcgatttttttacgactaatttatgattcctcttaaatttataaaaaatgcgggaaatatagtattctatatttcccgcagcatgcgattcctattaaattttttaattcttcctggaaacttaccgtcaatcagagtaaaatatgaaactggaaatcaaaaaagcgttcaaacgcctgcgccttcatatgctaaatccctgattaacggatggaacactttcccgcaaattggaaaattcatcacatgctgggcataaaaaatactgatatgatttaccggatcaatgcagacataagctcccgctgctccgccccagccgaactcccctattgggccgcgcccatttttagcgttaatttttacacggacgcccaaaccgtacccatactccgttccttcctgtatctggacatctctgagtgcctggccggtagtaacgcaggaagagaacattccaacagttttttcctttaaaattctttttccatttgcaccctcaccgccgcatgcaagtgcatcgattactttgctgtaacctgaaacagttccgataagtcctgcaccgccgctctcataattttcggtaaacttataggattcatcccgcctgcagggaataatgcaatttgtttttgcatcatactcatagattacggagagccttttttcctgcgtttcattcatggaaaataccatatcatctgttatatccaatggttcaaagatatatttatgcaagtaatcactgaatttttctttactgacaacctctgccaccgcggcaagcacatcatgggccagcgaataatgccatctggccccaggttcgtaaattaacggcatagccgctattgcttcaatcaattccctggttgagccttttccttttgtcttaatttgtgctttctttatagcctccgatgcaacatcataagtcatgcctcccatcatggacatcaaatcaataattcttatctggcgttcggaataatggcacgcatccgcctgttcaggatatttaagaagatgaggcggtaaggtatcatcaaactcattcgctgtacgcatgacctcatattccggaagatatttgtatacaggatcatataagtgtattattcctttctctattaactgcataaccgcagtgcaggtgataatcttggtgcaggaataaaggtaatacatatcattatcgcttactgctgtctttccctcataatctttatggccggtcatatgcctgaaaataatctcatgattttttgtcactatgcaatccgtactttttacaccgtaagccggctcaagagaatccaaaaaatcggttaatttcgtaaaatccataatctacctcatatgcttctttcttcttagcagcaattttatctcatttcttcctgccgtttacgcccgcagccggacggaaatgtgtctacataattaatatgttgtgcttcttccttggtaatatccagctgctcccagtcaattgtcttttcgtagcctgcataatcacagattctgattccgcataaaagtccatcttccccccgttcatatgccgcaatgcccgatatggcaatccggttcctctcctgctgtcctgcatgcgagattacatgtacccattcaagtacgcatgttcttccgttatccgttatagtctcataccgcatagcgacacatcttggaatataagctgcagcgctttcgtaaaaagcccggagatcttccgttccgtcattatcccgttccccgtccgcaggcgcatatcccccaaatttacaagaagggctgatacatcttaaaactcgttccacatcaactgacggcatatgatgaagacctgcataatactctcttacggcacccgtcaaaagatccggatcccccatttctaaatatgctgacttaaatataggccgacgatatgcctgcaggcccggtacatatgtatgatggcaataaatccgtacttcatcgagctcctgttttgttcttaaatcagctacaagaatcataggaacctgttccaattcgttatcaatctcaaaattgacttcaaattccagtactgcccgcccatttgctattgtttgtacagccggtaccataaacgccgaggccgcatgaaagcgggccagaaagccctgggagaattcacggattcccgaaagcccttcaaatctcccatagggcgcatcaaccgcactttttttcttcccaaataatttttcatcccggaacaatgacaatacatgttttgtatctccatcgcagactgccttcataaagcgaaattccggtgagcttgcatcaacagggtgttcctctcctgcaaaaaaccggacgagagaactcctttttctaattttcatcctatccacccttttcattataaactatattattatattgcctgtaacacaaaggtacctttgcaggccgccgttttccacggcggcccggcataaatacagttatataccattagcttccaggaattccttgaactgtttgtttttttcagcaataatattgtcaatacccgccgctttcaattcttcattgaatttcgtaaggtatttatccacatcaacctccccgtaaatcaaagcagagcggtattggtcaataatcatctggcaggctttaacctgatcatatacttccgtattgtcaaagacgaatcccatagcatttgaaaaccgggagctttcatcgaaccaacatttttccatgtccgtataatatgttgacatagtagtattgtaaggaatactcaggcactgattcggatagaaccagggcgcggataaattccatccgaccgtactgtcatctacgccatccgcaagcactgcacatccattatcatttacctgatatgtgactccttcgatgcctaaggtgaaaaagcggcacactttttcatctgtcatcataagattaagaagcttcatcgccgcatcgggatttttacagagcgaagaaatacaccagccgttatatatacatgaatttgttccgacgtaatcatttagcttaaaaagtacaaaatctccgtcccctgtggaaccctgtccctgcagcagcgacctgacgtattccagggaataaccgtccacccatcctccgcttgtcacattatccgcatataaggtacctgttggtactgtattctcaggatcggcaggtaccatcccgttttcgttataccacctggtctgctcacaccatgccctgaaagcatcgctctcataataattaataatttccgtctcacctactccacgattcattaacacaccaagccagtaatcatcccccagattatccactccaagtaatgataacggcgccatgtctccccaccatgcctgatccggaaacgcttcttccgcttttattataatttcatttaattcatctaaagaaatttcctgtccatccatatctgccacgcctatttcctctgcgacagactttcttaacatatatgtacaaaagtttccgaagctatcagcatttggcaacgaatactgttccccgttaatctgacatgtcagatatacaggttcagggaacatgctccaaagctccggatatgtatccttatatccttcaagcgaaataacctgatcattttttaccagagaatcaacacttgaataaaacctccagcaaaaaaggtcaatcggattatcgttatccgttaacagcatcgttaaattattgctgcggtctccccaggaattaacgataaactcagcctggactcctgcattgatggataccagataatcattcaacgctttctgtacctcatccttccgatccagcatatccgtgaagcttaagacatctacagaaatgaccggccagtcagacggattcacagatacttccggggactccgctttgtttacattaccatccgccccggatgagctgcctttagcggaatcggcagtatcggcgttcccacacgcagccagtgaaaccatcattacaatgcccaataaaattgccaaaatcctcttcatacttttccctcctagtttttaaattaactactatgtaaaaggatctgtaattactcatcctttaacaccacctataacaataccccgaataaaaaacttctgaaaaaacggataaataatgagtacgggaattacagcaataacagcaatggccattcttacacccagcgttggaattccttttgagaactgcaggcctatggatgtattaacgttatcttttaaaaactggacactggaagccattgaattcaggacattctgaattgtatataattcctttttccgcgtcagataatacaggccgttaatccagtcattccaataagcaagtgcagaaaaaaggcccaccgtcgctatcatcggtttagacagcggcacagcaatacgaaataaaatatcaacctggctgcaggaatccatttcggcagcttcattaatttcctgaggaatattggttgaaaaatatgtcctcatcaaaattatattaaatgcattcagcattaaattgggacagattaaaccaaagaccgtgttactgactttcattacctggctccagataatatacgagggcaccatccctcccgaaaaaagcatggtaaagaatacaaaaaacgatataaaatttcttcctgccaggtcttttttagacagaagatatcccattgacatcgtaagaaatacatttgcagcagtaccggtaattgttaccacaatggtcattccatatgcctttgcaatacttgctgaagccataaaaagatacttatatgctgcaaagtctatcttcttcggcaaaaaagaatagccgctctggttaattaccgcttcttctgtaatagaagaagaaactaacagtataaatggcaccaccgcagtaatgcataaagctatcagcacaatattagctaataaacaaaaacgctttccgtttccagccataattataatctcctccggttaaattatattagaacagtgcgctgtcaggctcaactttacggacaattgaatttgtaaccaatacaacgataaatcccagtaccgactgtaaaaatcctgctgcaagcgacctccctatatcatgatcagtcattaatgccctgtaaacaaacgtatcaattgttgtcgtcacctcatatagcatgccggtatcctgaggcacctgataaaacaaaccaaaatcagtagaaaacatccttccaagcgacataataaccaaaataataaccgtcggctttaatagaggtaacgttatcttttttatctgctgccatgcggaggcgccatcaacgacggcagcttcatataaagatttgtcaaatccgataattgttgcaaaaaaaacaatactctggaatccaaaactcctccacatctggacaaaaaccaggataaacggccatgcttcaggcgtaaggtaccaatctattttttgtcctcctaatggttcgataatacctttattaataaagccattttcattggagaaaaaagcgaaaacaagatagccaatcaaaaccgtgctgacaaggtagggtatcaatatcagaatctggtaaatcttctgcgccattacattgcgtacttcatttaaaagtatggctgtaaagacagcaattgctgtaccaagaaatataaataccagattatataaaatagtatttctgaacataatgcccgcccattttgagccaaaaagatatgtaaaatttttaatgccattccaatcactgccgaaaataccctttgcaaagctgtaatttttaaaggcaagcaccagaccaaccatgggcatataattattgataaccagatatgcaaacgccggtaatgccaaaagatacaaaaaacgatatttgtataaactttttctgtttctgttcatttttcttccccctttcaaatctctgtataaatcataaaagagaccgggttaataaaatacaaaaaacccgacctcttttatggcattttaagactacttattttttcctgtattcagtgggagtgcaccctgcaatctgcctgaagcttctggtaaaattactatagctggaatacccgactctttctgagataagcgtaactgacagatctgtcgtttccaaaagaacctttgcggcttttattttttcattagtgatatatcgtttcaagcttaacccggtgcttcttttaaatattctgctgagatattcctgattcaggccaaccagctccgcaatggaaccaaccgacaaatccacatcaatattttgatgtatatagcggataacgctttgtatcatattttcatcaaccgtttcaacacgttcgtataatttttgaatgatgcaattaaatgcgttgctgaagtcacttacatgatgataacaatacataaaatcataataagacaaatcttcatcaaaaacttctgtgctctttacattattgtctgacatataatggaaaaacaattccgtaatttcctgatgaaacctcatcataaatttttcatttattttattgcccgccgattggtgatgaagataattcaacacgctcttcttaaaatcgataagccgattctgatttaaaagtgactgccaggaagtaagctgtaaatcaaaggaatagcctgaggttaaatttcctttcgtttccccggcaagtataacccggcttgaatcctggacattattagcctgtgcatgtaaaattttttgatacatttcacgaagctcctcttgtaagcagtagtctccgcaataaacagccacctccgttttcagaagcttttcaaacatgtacctcaggttttccagtttatttattacaatcgccaattccggcttattttcctgatgaaacagcaaaaatccaataaagcttccttcagcgtcattctgaaggttaatcacaattcccgcactaagagagctcataatctcttcaaggatgttgtaatatatccctcttaaaaaggagtgttcttcttccttccataagtatcctgattttaatatttggacagaaaataataaatactctgtctctttttccgaaattttcacatgcatatcaaggagccgctttaaataatcctcattatccgttaagttccgcagataacgcaccacatttacatccagaatatccatttccttatcccggaaaaatgaacctgttgacaacagttctttatttttctgttctattgcaatttgcgattttgcccgttcgacaacatttttgagttctgtcttttctaccggctgcaatatatagtcaaaactttgtattgatattgcttctttcatatattcaaaatctgcgtgcgcggtcagaaaaatcactttactgtccgggcacttttgcagagcccattttgcaaagcaaattccatcctcatttggcatgacaatatcacacagaaatatttcatatactttattttttacaaatatacgtgcctcttccgcactatacgctatatcaaggagatccttatcctcattcatttccgaaagctgtgaaaagactgaatttgcaattatcggttcatcatcaatgataagtatattcatctaatatcccacctaaagtaatttctgtaacagcgcccccaaatgccgcattataaaaataaattttagcattttctccatagtatagtttgattctatatttcagattttcaattcccacatgttcactgtgatactcaaattcagtgacaggttgattcaatacctccagatactccgacggatagccatcaccattgtctgaaatccttataaaaagcgatcttttacctgtatcctccgtaacaaaacggatcatcacacctacatttaaaagcagccctcttttcactacatatttaatcgaattctcaacaaaagtctgaatggcaaggacaggaatcggaaccgccataacttcttctccggcctctatatccaggataactggtatgccggctttaagggtataaattttacaatattccctaacctcgttcacttcctcctctacctttaccaggtgcctctgattttgaaaaacataacggaaatgtgatgataacgaataaatcaaatcctttgccgcttcactcttcctgttttcaagaagcgaatcaatagtatttaaacagtttaaaaaaaaatgtggattaacctgaagctggtaatattgaagcagtgcattattcgcccggatctgctcccggtatttctcttcacgaagctcgacaatatctgttatcattgtatctatttccctgttaatattatcaaattcaacaatactccatcgtaccttttctgctgcctttgcatcttctttcatttcattggattttatgaccagatgttccaccggctgtaaaagtattcggttcagcccccgtaacaaaatcaggagaatcccaatcaacacaacaggaaaaatcagcatataaatccataaatttgagcagaacatcaattcatataaagtcttctgttcacgaatcagaaccagatccatatcacagttagatacctctgactttaccataaaatgcttattccctttatgtcctttagaattgggaagaaaattctgtatttcatcttcttcggcaaagttatttccatcaacagaaataacttttcccgatttatcagaaaatgccaattcatattcctctgacttttcaaaataacggcttaaatttataagactgccaacatactttccattcatgccgtaagaataggaataatagatttcgttttcatatttaaagtatcctgtatttttataatcggaaagagtatccaggagaaatgatttagcttcaccaatcaaaaggttcccgcttccggagaattgccgatcattccatacaaaccgaaatgccttctttggtatatcaagaaaatacatggcacccatataatccgcggaattaatatactttgacaatgtattctgaagaagatatgccgtaccatgccattcgaactctgatatgccatcatgtacgagtttttcataattcacatcttctgcatagatcatatttacattattgaatatattgtttagttcataatttattttttcagcataattatcgactataacctgactttcttcaatgtctttttcctgataatagtttaaaatagtaactgtatatgagaaaaacagtatgaaaaacaaacccagggtcactgcccagaacaaaaatagcatttttttcagtgaaatttttcttttatccatattgcccctgcttcccggtacattgcttatatatcgatactgtggatatctccgtaacaaacttctcaaatcttttgtgagattattattaatgataacattcttattctaattaagtctactcctaaatatatccagcggcggctggcaatctgcctgtataaataacgaaaaaacagtccggatttttatggataaatccggactgtttttcgttcttcctgcctttttatcactttctgccaattccgataacatcatggacaaaatacaatgccatcgcctccatccggcggtttccgttctccgtaaagccatgtatttctccggtaaacacctccaatttcccctgggcatattcctccgccgcatttttaccgtactctatcggcacgatctcatcctgatccccatgcataatcaataccggctgtttaaactttctgatgtatgtatggatatcaagccccctcaaggtacggaaaaacttatttccaagttccatcccccaaaattccagttttggaggaatatcctcttccttttcaaaacgtgtattccagttatcgggaatacaaagtgcaggatacagcaatatcaggccttttacatgctctcttctgtcagcggccgccatagcgctcacaaaccctccctgacttcctccgaaaaggaatatccggtctttttgtacctgcttccatgtaagaacctcatccaaaacagcgcacagatcctcttcctccgtatacagggtcatttccgtcgtagagaaaccactttcatcccgtacgctcccgccgcagaaagtatagcacaccgtaccgattccattctcagcaaaatactccgctgaaatttcaaaatcagatttatgtccgttatatccatggctcataatgataagcggatattccttagcatcaggctcgtaaaaaaagccgtataccgttcttccgtgatgtgtaaccaatacctctctctttttcatcttctctcccatttttcaaaaatataatctaatgctgggctttctccgtaatcttatccctgttcttttcaaataccggctgcatatacttcttaaaaaccggcataagttcatgatcataattgcagcgaagctccgcttttacatcaaataccattgtctgctctttctcaggtatgctggcaggccaaaaaggcagattaccatgattcggatcgccactcctggcaaaagccattaccgtatcaaaaatcagtttctccagactttctgtacatccttcctgtgtggatggtacaaattcagtattatggaatacgtagggaatatcagaacaatgccaaggtgtcgaacctccttctataggcatgtcgtgattaaacatataagagtaggtgcactggttcaatccgcttcttaaacgaatatatttgtgtatgccatttcggaaaatatagtccattctcacaatatcgctgatatgtctttcaggatatgctttcttaaacaggggaacaagctgcgcagaagcttcagtaccaagcatttcttccacaatccggatttccgcttcctctgacattttctttttatccgcatttcccggaacaaaagaagccatctcaccgaacacggatcccaccaacatgggaatatgagcggtttccttcctgaatccataaagcagcggatctcctgcgtaaaactcgttacggaaaggtaaatctcccacatacctgttttcttttgcaaaatcaggacgcaccttcaaataggcatccgccagtctctgatatggaacctcctcaagctcttttaccttactgacggacaattcagccataatgctttcagccagggctttcccgctttcttcttcagccggcctttccacatcaaggacaccgctcatagaataccctttcgcatataatccgtccgctcccggagattgcagcaaggtagttacttttcccccgcctccggactgaccgaatataatcacattatccggatctcctccaaatttttccacattttcctgaatccatttcagtgctgcaataatatcatctcctcctgcatttccggaattcatatattcatcaccaaactcagaaaggtcaaagtatcctataatgttcagcctgtgattaatagaaattgtaaccacatctccaaatctgctcatgttttcgccttcatatgctatatgttcaatggcagatcccgattcatatccgccgccatgaagccataccataaccgggcgtttctgttcatcacaagccggcgtccacaaattcagattcatacattcttcgttcataggccagtagcggtgcggaacaaatatttccccgttcggttttggcagatacagctgcggacaaacatatccatagcttgtggcatcaaacacatccttccaagccgtaacaggctctggcgcatggaatctcttcgccttcgcatacgggatccctttaaatacataaatatccttcaggatatatccccttacttttcctttcgtagtttctactactgccgttctgtcatcaaattgaaatcttgtctccatcttcccctccattaaccttttattgatccaatcataacaccttttacaaaatatttctgtacaaagggataaatacaaaaaatcggaagtgtacccactacgataacagcatattttaccactcttgtcaaaagaagcgttgccgccgagcttgcactgtctcctgccgccagcatagcagccccctgctgagatgtaattaaatcctttaatacaagctgaagcggccacaagtctctatcctgaagatatatcatagctataaagtaactgttccactgtgcaacaatcaggaataaagcgattacggctaaactggctttggacaaaggataataaatccggaataatattgtccatgcgccggcaccatccagttttgcactttcttccaggctatcgggaatcgacaggaaaaaagtccgcattatgatcagattcattggagtaatgcatcccggaataataatagcccacatggtatccagcatatgcaggttattcataagtatatagttgggaatcaggcctccgttaaacatcatagtgaaggtgatcagcagcatcaccggatttttcagcttcagattctttcttgacagcacatatgcaccaattgatgtaaaaagcactccaagcaatgtctgcaccgaaacatatatcaatgtatgcaggtatccattccaaactgtatatgatttcaggacttctctgtatccgataagtgaaaattttctcggccataatacaagccccttgctcagggcaagagcttccggttccgaaaaagaggacataatcacatgaataatcggcaggatgcagataaccgatattgtggtcagcagtattgcattacataccgaaaacacagtttttcccacactttttgattcaaccatagtccctcctagaacaagttcgtgtcgctgaactttttcgccagcttatttgccacaacaataagtacaaaattaattacagaattaaacattccgactgctgttgaataaccgtagttgaactcttgcagaccttttctgtatacaaatgtggagattacatctgccgtttcataaatgtttgcattatacagaagtataattttttctgcgcctacagctaacatagttccgcatttcagtataagcataataataatcgtagaagaaatttccggtattgtaatatgtatcgtctgctgccacctgtttgcgccatctattgcggcggcctcgtacaattgctgatcaactgcagatagtgtagcgacataaatgatactggaatatcccagcccctgccaaagctcgcttactgtcattattgccctgaaatattgaggatcagcaagaagatttttgctttctcctgtcagcgccgtcattaacgttcctcccagaatcccgtctgaagaagtaaaatcaataataatgcctgccagtaccaccaaagaaataaaatatggcatataggtgattgtctgcactgccttcttaaatcgcagccgcctgacttcattcagtaacaaggcgaatataattggtagcgggaagcagattagcaggcttagcaggctgatgataaccgtatttctcagtacacggccaaaatacacgctgttaaaaaaatctatgaaattttttaagcccacaaagctgcttccgagaattccgcttgccggccggaaattctgaaaggctattaccagtccccccatagggatataggaaaacacgataaaataaatgagtaccggaagcagcatcaaatagtaagctttgtttattttaatatcatggagtaagctttttttctttttcacatccatctctccaatgtcatctgtcattatatctgtcatagccagtctgatagatactcaaggcatcttcaattcccatagagtaaatctgccggacggtattatcccagtttgccaaagccgcaccgtcagtgattgccttgatggtttcctcctgcacataggtggaaatatcactcataattgttgatacctgctgctcttcttctgctgtcagagaccagatcgtattatactgttctgtcgattctgtccagattctattccattcctgattctcttttgatttaaattgcgcattccggtatttcgcttcatccgatactgcaaaaacacacgctacattcaggcgaagcccatcagaagaacctgagggataattcaatattttatcagtaaacgtcggttcaccgtcaactaatgtataagtttctccttcaataccaaaattgcttattcttacaccagcatcagaacataaatagtcaataaaattcatggcaagcttgggatcggaacaattcgatgtaattgcaagccagctgccatttccgcagtataattccttaatggatactttaggtatcgattcatctgtaacctttttcggatatcctactgcaacagcctctgcgcctggaactgtattctgcaaagtcatcaccatagaaggcagcgggccatctaatgtataacaggctccaatctttccttcaccaaacattgcaagaaaagtatccattgtggagagcaaagatcttgtcataaattccttatccagcaatccttcctgataccatctgttcattgttgtcagatactccttgtacccaggctcaactgcgccataggtcagtttgccctcctccccaggatatatgccaacatcattgcggaagtcaaccggagccttctctattccatatgccgccagcaatgcctgatccattcctgtcgtgttcaacatactatatggcacctcaatgcccatatctttaaatgccaggagagttttttcccattcttccactgtttgcggtacatccagaccggctttatccaacagatcctttctgataacctgtccccaccactgaagttcctttccttcaaattcaggcatatattttgcataggcaacagccatcctgttttcaagggtcgtagcttccttatatgactgctcattttccttaatcaattccagataattgggcatatattcttccgcataaggtgcaaggtcgataaaacagccatcttccaccgcctgatccatacctcccggataagaaatgcctgcatttcccacaataatatccggatagttaccagatgcaatcaaaaggttaaactgtgccgcttcctctcctacagccggaacaatataattaattttaatgttggtattttccgaaagcttttgataagaaggattactgtcaatcaactgctgcgtgaaggtctgtgcccctgaaaaattggcgccgcctatggcaaagaaaacatcgagttccttctgttcttcacaaagcggtccaacataattattattttcatctctgttatttaaagccgccgtgtcactatcctgcactccctgtgtggtatcttccgtttccaaaggaaccggcatatctgtcactgcctgactctccggcgtttttccgcttgttttgcagcctgccattgctgctgccgttaacgccataagtcccaatactgcaattccctttcttattttacctttcattgctgcctcctgttcttttcctaataattgaggtacctgtcatcagtttcctttccaatacaaatctatccggatccaaaacaaatctgtgtaacagaacattagcacagttattatcctgttgaaagttccttttacaagccgtaggaaaagaaaaaatgccattttctgacctttttcggtgaaaatgacattttccgcacaaaattaaaacaaaactgacatatgaaaactcctgttattccttcttctcacacctattttgctttctatattccgtgggcgtaattccttccgcctgcttaaaagaacgaatcatagttctgtatgagtaaaaacctgactgctccgcaatatcattaatattcaaggaagcatctttcatcaaaaatttcacccgctctatcctcatttcattcacatactggctgactttcatattatattgttttttcatcaggcgagtaacatatccttccgatatctgaaatttctccgctattgatgaaagagaaagacccgggcttgtataatttgtgtcaatgtaatcttttattctttctgccttcggtctgagaggctcatttgctgccagattatttttaagcatatacagaagttgtgtcagccaatcggcaattcgattattatcacagcagttcattatgctcattatttttttatcacaatcagatgagaattcagaactgtcggacacagcatctcgtatcaggaaaagaatatggaacagatataatctaatccctgcatcatcattatccaaattactgacatcctgtatcagttcctttactaatttttccgcactattataatctctgcttttcaggaaattaacaaatctccattcttttcggctctgaatatttgaatcaatctctctgtctatatttttcccccagtcccccattgccagtaaacattcactgtaactgctgcgtaactctgtcagacggatacattcaaaactgcaaaaccaggaaacagaaatccccattcgctctttcagaaattccttggttttattgctcttctcctctatcagcgcttccgctttccgttcttcctgattgctgtaattaatcagcagtacaacaaaattatcacattcaactggttctaccacaggaaaggcttctttcatacattcggttgcaatattctttatcaaaaaatgaaccagatcataagtatctaccctattctttgcatcattatcaaaaaaaagagttgaatagtcttctacagaaaaaagaaccatgcgaaatatatgatgtggaaaatgaatacagtactggtccagcacgttttcgatttcttctgatgagacataataaccttttataatccggcttagaatattatttacaataacatccctctcttgatccatttgatttttcagtgcatatcgatcctccgcaacttcctggaaggccttctgcaaatattcaaattcaccttccgacacttcaatgggatgctgcctgccaattgtctgaattagcttcaacaccggattatactgtttttttaccaggtagcgggccagaagcatgctggcgactaagcttaccaatatgaagcatatataagcgttcctgctgtggtaaatatcctgaaacagcgaagccgtatctatcccgcaataatactcccagttttccgtctccgattttactttggcgataaatatatcttctccctctttctgcatccttgtataagagtccattctcataagttcttctgcgctttcaccatcataactttttctccggcctatatcatagaaaataccggaatcagtcataataccttccagtgcccttcctgaatttgaattgccggcttcgaaatccagctgaatcagaatccagccatcaggattcctgatatccttagaagtaatcacgttataataatacaggtgcgattgaccgataccgtcttccagaactaaaaccgactgccctgaatgctccagaagatcccataattctttttcacttctgttaaaatgcctttcgtaatcaaaaccattggttcctctttcattagatgcctgtctgggtgatatcagatacctgctctttctggaaaacacaaaaatatctttgatacagacttcgtttgccatctgagcctgtaaaaacttaaacaccgcctgtattgcaagtttgctttctccgctttccgttgtttcatgtcccatgaaaccaatcacataagggttttccgctaactgcctgcttataatatgaactgtctccatcttcccatcgcatacatattttagctggttcacactattctcctgcatttgctgaagctgttcggaaaggactttcccaatataggaaaacataaagaaactgagaaggataggcacacaaatcactgtcatataagaagcaaaccataaaagaaaagttttgctgcctttcctgtatttcttcaatgtctttttttttgataacccactgataattcctcacccccaaaagacaattaaaccatcaattcctaatcctctgccttttttattgccttaatccattttccgctgcgcagccgccatacgcaccagacacattttataatctgatcaatcttcatgaaaaaataaatccagaatgcaggcatcttccataccagccctgccagaattcccagcggaacagaggccagccaaaggaacagaatatcggcaaacattaagaatttcgtatccccaccaccgcggagcactccttttgtcagtatggaattggccgaagtaaaaatcaggataacagcaaccgattccatcagctgctccgctatccgacgtgtttcgtcctgaatatggtacataccgattacaggcccgctgatagccagaattaccacacaggccgccacacccaacaatgcgccgaaaatcaggaaggtatacccttctctctgcgcctgctctctttttccttctcccagggtatgccctgtgattatgcatccggcctggctgatcccctgtgtgagaaccgtagtcatctgctgggtaacggcggtaatggaattggccgacacaaaagcggcgccgatcctccccataatcatggcaattgcactgtttcccaacgccaggagggaatcgcttatcaacaccggtatacagatttttaaatattccggtaccagcccatggcagtccataaacaaatccttaatccgataacctatgtttttatcccgcaaaaaaaagtagatggcaatcgctgaaaattctatgattctcgccagcagtgtccccagcgccgctccggcaacttccatacgcggcgcacctaaatttccgaaaatgaaaacccagttaaaaaacagattcgccataaagctgacgctggaacagataagcggtactttagcctgccccacacttctgagtacaatcgtgcaggtaagtgacaatcccagtaaaagatatgtaggcaccgaccaattgaaataccggatcccttccctgataatatccgcatccggcgtatatatacgcatcagcgcccccggagccagaatcgtagccgccataaacagcagaccgaaaacaatgcacaatcgaagcatgatggtaatggactgcttcagagaacaggaatcctgcattccccaaaacctggctaccataaccgaagcccccatgccgattcccatgcagcatacatgatagatattaatgaactggtttgccagggaggaagccgatagagctacttcccctaacgctcccagcattacggtatccatcatattcacccctatggaaatcagactctgcagggcaataggaatagctatgattcccacccgtttataaaattccgcagttcccagatataatctcagttttctattcaaatgcattccatcctttctcatcctgtcattgttcctttttaattccgtctttgaaatacatcctgtaaaaatgcatccgccagctgcagccacagttggaaattggggtattgattttctcccataattgtaattcctccctggccatgcggcacaccggcaaaagtatgtacctccgcttccacaccatgggctaaaagatccggaagcgccgcattcagattatccagtgctgtgtcctctcttcccaccgcaaaaaagacgggcggatataccacatccgtataatcaaactccgcacctttataacgcggtccgtatatacacagaaaagcatccggcgctccataatagcggtccaaatcatcctccatgtaatccggaaaatgatcggttgttctttgtgccccggaataatagcggatacatgcttctccggtaaggcccccattggaaaatccggcaaaggctacctgattttccctgattccataagagcctgccgccgccctgaccatacgtatcgccctcgccgtatcagcgccgcactcctgctctgtccatggatttctgttcggacggttcagcaggaggaaactgtgatatcccattttgttgaaatccaggcaggtctgatatccttcgctcacaacacagtctccatggtctcccccggcacagacaacgattgcccctttcggcttcctgtcagaaggcagcagcatttcataaagatacggcctgaaatcaggattatggttatacctgcagccataattatctttatactgtgtcattaccggcatttcaccctcaggccacaaataaatccgtttcggtgcattcccttttcgcttaagggaatccctcagcgtacagaattcctgcagcagtcctttacgtctctcgttgtctgcgtcaatctccatctgccgtcccaaattccgcagacggaccagctgttccgccggataacagggtgcatcttcaaaaaaaggaacggctttcaacctctccacagctattgttttttccaacagttccttatcttccttattttccattctgatctccttttcttttcaactctcacatcaggtttcaaatgtataaaaagctgcctctcggcaccgtcatctataaattgttttgctaaagtttagcaatattttatataaaaagcgacgctacccttagatagtccgccgctttttacaggaacatgccgtggaatcccgggcaccctttattttcatggagtccgttcatacggtttttcctgaaagctttctccgtaaatcagtttcgttacatgcagcttggaaagagtcatatgaagatcattctgcaggattgtcaataccagatgcatggcattcgccgccatttccgctaccgacacatgaagcaccgttacggtgggataaagatattggctgaaatccccgtctccgtatgcgatgatttccatctgccccggcacctcaatatttccatcacgaagcgccgcgagaatgccgctgctcatcctgctcgtctgaacaaacagcgcggtaggcagttccctgcactgaagcatctgccttaccgactcataaccgccaatcccattcccttccccggtcaccttccattcatccttcagctgaataccacatttcctgcattcctctgcaaaaccattatatctcaggacacttgcggcgctgcggttttctgatgacacaattcccgcccgcttatgtccgttcctgcaaaagagttccgcacactgcctgccggtctgatagtcatccacataaacactgctgtaattttccagggtctgattaatcagtacaatcggtatttcgaacgtgttttctctcagataaccgctgtcaatctccgacagtcctccgatgatagcaccatcataccgctttcctgaaaatgcgtcctccagcaggttcagatgatcatactcaaaaggctggagaacaatttccacttctgcatgatactgctttatcgtctccaaaaaaccggaatagaactgtcccaaaaggccgcccatataatgcaggttccagaatacaccaatacagaatttctctctcctggcggctgtcttctgattttttttctgatttttgccggactgatagttcatctccctggcggtatccaatacaattttctgggtttccttggatatcctcagttcgtccccccgcccgttcaggacaatggacaccgtgccggaggacagccccagatgctccgctatctgttttacctgtacacctctggtatttttaggcattcgcttccgctccatttacatttcatatttttgattccgtaaaaacaaatttctccccggacagtttaccgtaccgtcattcagaaacgggctccatctgcatgccggccggcagtgcaggcattttccgcactcctttccttccagaatgtcatttccgaaagcaggatttaccaaaaatcctcttcccacatcgaccatgtctatccctgcatgcagaagggcattttccgccatctctccatccgttatgccgtccacgccgaacaccggcatatccggcatccgttttttaatttcctgcgctccataaatgacatctgaaaagggatatccttccgggctgtacgaaaagctttcgccggcaaaaccataggatatatccagaaaatctgctttaccgttcagcgccagcgcattttgaattccatcctccaacgcaggttcgaaagccccgagccggattcccgccgcaaaatcatccccacagctttcacgtattccctccagtatatccagggcaaatttttcccggcactgcccataaatatcatccctgcggttgatattacggttaaaaaactggcaaatcagataactgtggcagccgtggagttcaattccgtccagccctgccagctgtgcccgccttgcggcctgaacaaaatcatcaattacttcatggacactggacagagacatcccgcagcccctcgcccgcagttccccattgctgtccctgaggatataatcgctggggcaatcggcctctttttctattcccgaaaccccggcatgcagcaattgtacaaaaaagggcacgtcataccggtgcacagcatctgccagccgcttccagccttccgtctgtttatcttcccaaagccccaattgagtttcatgcagccttccccgctttgataccgccgtggcctcaccgataatcagccctgcccctcctgccgcaatatcacgataatgctgcagattcttatctgtcacataaccgttgtcatccgaccagtgaaaacaaaccatgggcggaacggcaatgcggttcttcgtcgatatgttccttatttttacccgttctcttattttatccacgtgattcctccctcgctgtatgcagggcagtcctgccttccctttttccgctatccatacctgtctctgatactattcttttataatatacttttttgaagccgctggcaatctgttaattgattttttagcaaaacattcaaaatttagctttacttaatcttttttccgcagcagttatacccgcggaccgcctccaaaaaattccgccgttacagaacgatcctgctgtatcatcttaaacggatgctgtgacataaaattaaccagttcttcctccgaatccgctgatttcacctcacattcctcatcaaaatacatcattgcaggctgattctgcgtatagggcagccatacaggcgcaccagctgcccccggcctccccttttccgcaaaactgcaccagcattcacatacaattgtctggacaagctctgtaattcccggaatgtaggaaggttctatataatccgcattatggaatacgtatggtatttccgcattatgccagggaagcgtaccgccataaaccggctgttccattttgaacatatagccatatgtatttttaagaccggcctgagcccgtgctttcaaatagtcgaaggttcccggtcggaataccctgtcggtaaaaagcagatcttgtattcggttcccgggataggcttttcggaataattccatggcttcttctgccggctcacccagtttttcacgaatcagcgcttccgccttctcctccggccagctgtttttccgtccgtcatcgcaggttacggcaaaattctgacagaattcacccaaaacatttccgataatcaccggtatattttttgcatgctcacatattccggcttcaaaaatactgccactgtaaaagtcatcatccctcccgggcccgaagtccataaatgcatgaggccctaaatcagagatgatttgctggaaacgataataaggcacctcttcgatttccctgatccgttccggagttatttccagctttcttaacagcagttccgtcatatccgggcctttttcttttccggctctttcccgtatgataccgctttgaatcactgcccggtggaacaatccggctgccgatggtatctgaagaagggcggcaacctttcctcctcctccggactgtccgaaaatcgtaacgttttggggatcaccgccgaaggcttctatatttttctgcacccagcgcagggcttcgatgatatccgccatccctgcattcgcggaatatctgtattcttctccatatccggaaaggtccagaaagcccagcacgttcagccggtggttcagtgtaaccaccacaacatcaccgaaacggctcatattttccccgtcatatgcaaaatgttcgattccggatccggttgcgaaaccgcctccgtggagccatacaagaacaggcctctttctttcaggatccggtggctgtgtccagatattcaaatactgacagtcttcatcctgagggtaaaacacatgcggcaccgtataattgtcacttggctgtacggtctggatttcagggcacaccggcccgtagataatagcctccttcactccctcccaggcctttaccggcgtcggcatatgaaacctcctggcatcggcatatttgattcctctgaaaatataggtatcgtcaacaattaatccgcggagcttaccgtttggtgtagaaacaaccggttcatccgggttacaaattacctgttttgtcaatttttttataaacatataagcctcctgccggtaacggttcacacagtgccgaaccgttactcctgctgccaactatttttttgaacctatcagctttgaaaaatcaaccgtccgcgaagggcaaagccttatcagctccaaatcatgatcctctcccatcctgcattctctgtcaaaaatcatagtccggttttttcccccgccaaagggtgtccactgcgggacgccacagccgttgggatttccgttttcggcaaaattcacccacgcctggctcatgatatcctgcagttttggagtgatttgcggaataaaagaggcttcaagatattcggcattgtggaatacataaggaatctcggcgttatgccacgaaaccgtgcctccgttaaaaggggattccagattaaactgaaaattatagacgcccgcatccgtaaacccggcccgcaaaccggcaaaggccgccgcattccgcctcatttccacatccataaaaagaatatctgcaatatttttatccggatatgccttttggaaggcgtttattatttcctctgttttttctccgtattcctcattaagcagtacttttttatacttttccgtccaggaatttttacttccaattccaacaggagatgcaaaattattcataaactccccgaatacggagccgcaaagcacgggcacggccttcgtttccctgataaaaccgttttcaaagggattcccgaagtaaaaatcattatccttaacggggccgaacatgacgggtcggccttcctctccgtaaagccgcccggccgcataatccgctgcgcgcgccagctcgtcgtaatatacgctctccagctcccttacatgctccggcgcgattttcagatattccagcacatatgccgccagcttaccggaaagctccttcgtcatgtcattgcccggcctcattccgccgctctgcagacatacccggtggaaaagtcctgccgcccgcggggactggagcatgctcattaccttgccccctccgccggactgcccgaaaatcatgaccttatccggatcgcccccgaaggcttctatattctcctttatccacgcaagggccgccaccagatccgccatccccgcattgccggaatatctgtattcctccccatatgcggaaaggtccaaaaatccgagtacatttaagcggtgattcagggtaaccactacaacatccccgaattttgacagttcctctccgtcataggcataatgctctacgccggagccggtcatcatcccgcctccgtgaaaccataccattaccggtcttttcacgcctttttcaatattctgcgtccatatattcaaaaactggcagtcctcactctgcacggtaaaataatgaggaaccgtatactggtcatggggaacgcaggtaaagacctccgggcaggcgtttccataggtaatagcctcctttacgccttcccagggcgttggcggagccggcatgtgaaaccgctgcgcctgcgcataacgcacgccccggaatatataggttccgtcagagatgaccccgcggagcatccctgactttgtacacacctcagccttaccgtagtccaaaataacctgacgggttaattttcttatatacataataatccactcccacgtctattctgcataaaagttcacggttgtcgtcagcccgtcttccgtagtaaaggaaacacttacctctcccttatcctcaggcataaccgccgcgagaagaaggccgtgaaacatcttcctctccggcttcgcatataccgaaaggtcaagaagatcacccgcatccatccccacaagatgagcaggcccttcaatcttacaggaaaccaaaggacaggcatccgatacaaaacggcactcattatcccttgccgaaagttctatctgcacaagagaatccacagcaaattccgtgttataaatctgcgcttcaagagaagccatttttcccgtcgtgtatacctcatccaccgctgtcagttctccgtttctgtagccctccgcacgcagcactcccggctcatatgccacatcccaggaaagatgaagatcatttgtcgtggaacgtttatggaatccttcattccaggcacgcaccgctccgtatctgggacactgatatcctctgcttcccacataacggccgtttatgtaaagcttgacttcctcacagttggtatagcagatcacctgcttgtaaacgccctcctggccctcaaaattccactggggcgcaagatgaagcgtagtttccttcgtattccatatagagcggaaatagtagaaggtatccttcctgaaacctgccgtgtcaagcggcccacacggcgcacctcgtctcggccatctggtttctcccagataatcaatgccggtccacagataatctcccgctacaaaatcatagctggccgtatagcgccacaaggcttcatgatgcagcgaagcggtcgcgtaatttccaaaccatccctcctgggaatagtctccccggatgcctcctgcggaagggttttccgtgccgatcatacggcgttccgggtactctttcctatcctcctcataaaaggtttccgcccgttctctccaccgtcccacatagttataacctaccacatccagggcgttctcaaactcacgcagggtgcggatcggctccactgccgcaatattatcgcaggcggacgtaaccatacggctggaatcctcctgatggcagatatcctgtaaaaatttcagtattttcacaccgtccacagacgactgctcgggaatttcattgccgatgctccagatgaccaccgaaggatggttgtaatcgcgcctgagcatggcggttaaatcctctttcgcatgatttgtaaagaacatgctggaaccgtatgccaggttttccgaataataattatccgtcttgttcttcgccaggagccattcgtcaaaagcctcgtccatcaccagaaaacccagctcatcacagagatccagcagcacgggagccggagggttgtgggaacagcggattccgttgcagcccatatctttaagctccttcagccttctctcccaactctcccggtatcccacagcgcctgtcaggccgcagtcatggtggacacacattccctttatttttacagtctcaccgtttaataaaaagccctgatccgcgtcaaacaccgccgttctgatacctgttttgcaggcaaaggaatccagctcccggccgtccgaaacaacagtgctcaccagcgtatacagataaggatcctcatccgtccataagtggggtgattccacagtcgggcgcaccatacagtcgctgctttcacccggttcaagatacagtgcaattccggatgtggaaacgagcttcccgtcgcgatcgtatattttatggagaacccccacattttccgccgtgccgccgtcattgacaacctgcgcacggatctgcagcaaagcggtatcctgctttggataaatgccgtttgttgcgcagcgcactccgaaatgatcaaaatggatttcattggtgcgcaccaggtaaacgtctctgtatataccggaaccgctgtaccagcgggagttgggcacaagatcgtttttcacgcgtacagccgcaacattctccccttccctgacaagctccgtaacatccacataaaaggaggtatagccgtagccgtggccgcctgcctcttttccgttgacatagaccgtggagtccatatagatgccttcaaaatacaaataaagcttttccccttcggaaatattttccaaagtaaaatgtttccggtaccagccaatgcctgatttaccgtagccgcctccgccgcctgtcttttccttttcctccggcgcataatcaacgctccagtcatggggcaggttcagggttctgaaggcgctctcatctgcatccgtccgggaaaaacactccctgtcttcaaggataaatcgccagtttttattaaagtttattgttttacgcatattgatgtcctttccggcctgtcggcctgtcatatccaccggcgttatattttaaaatgacagccggtgatatcaccggccgtcaccttacgcaatgggattttgctattcctgtcctttcctttcacagaatgcctcatactgaacccggcattcctccataactttactcagtccggcttcttcaagcttgccgataaactcctgatacttcgcttccgtctcgtcaccgaacagtccaatattaaagcttgcgccatactcctggacgatagaggtaattacagccagttccgcttccacgttctttttatcaaaggtaaagccggatgcaacaggcgtatattccttcgccgtacacatttcatccatcatgctgcttctgggatcatcactgtaaagctgaggactgtcttttccggtaattccccaagcccagttgccccatccgtatctgtcggcagcttcgcccagttttctttttccgtcatccgtcatttcataatgaacaccttcaattcctccgactaccagattgttgacctccgggaagcccttcaggcagtccaggacaagcgccgctctttccgggatttttgaagcattcggaatcgctatggtatcgtccgcatagctgcccctctgcgcctttgtattcggtgtaacatcaaaaatttcatatgtgcctatgccggctttttccagattttcacctgcgctcacaatagtgctgttccagataaagctcgctgtttttccgctttcaaaatttgtctgggcatccgatgtatcgttaatcttattgggagaccatacatttttctttgccagctccgccatttccatatacagctccagacattccggcgcggtatatttatagaacacatccttatcccaatccggaagcttttcctctccgtgcgtaaaatacatgaaatcaaatccgcttgccagcggttccgcttctatatgctgccaccatacatggtctgcaaactccgcattgcctctctgtccattggcatagatgccgttctgtgtctctttttccgccagtgtaatcagagcttccttcatggtatcccagctgttgatttccccgataccatgcttttccattaagtcttttcttacggctatcatattatagttgttaaatacggcgtaattctttggtatcgcaaaaattttaccgctgatcattacctgatcccagctttccggggcctggatttcatagctgtaaggaaggtaagtctgcaggaattccggcgtcagctccttaaatgcgccttttcccgcttctgaattgtaattgcaccaggaggaggtgtacatcagatccaccttttcaccgcctgccagaagcagggagtatttcgtctgcacatcgctccagcttaagaatttcatatccagggttgtgttgagccacggctccagatattctccgttcagcttctcaagcaccatatccatgtcttccggcctgtcgccgatcgcatacattaccacgtcctcatgcttggaaagatcgaagcctttgtccctgtagggactgtcttcggaaattccctcattacctccggcgccctgattttctccagccgccgcgctgccgccgacttcagtccccgcagttccggaagtatttgccttcccacatgccggaagcatacaaaggactgcagccaaccccaatgccatcacttttttccatcttttactcattttctttcctcctctgcttttttatatataatttttattcaaaaactatcctttgactgagcccactgtcatgccttttacaaaatatttctgcaggaacggatacagcagtataataggcccaatggcaaccacagtcatagccattttcatgctttccgccggcagcgaagccaccttcattcccgtctggcttgccatcctgttcagcgcctcggagctgttcagaatattctgtagggtatactgcagattccatttggaactgtcattaatgaacagcatacagttataccagtcattccaataaccgagagcggtaaacagggacagcgtggctatcagcggcttcgataagggaaccatgatacggaaataaatcagccactcactcgccccgtccaccttggccgattccaccagctcataggggattcctttcataaagctcttggcgataatcatattccatacggaaaacaatcccggcagaatcagcgcatataaatgatttgtaaatttcagcgtctgcgtacaaagcagataccacggaaccagccctccgttaaacaatgtggtgaaaaagaagaaaaaggaaaaaccgtttctccacggaaagtccggcctggacagcacaaaccctgtcatcgttgttatcaatatcgcaagcaccgtacctgcgaccgtgacaaaggtggtaactccgtatgcggaaagcaccgcttccgggctcttgaatacaattttataaccttccgtggaaaaattctccgcgttaaggaagaagctgtaacccttcgtaagaatccatttttcatctgtaaacgatcccgtcaataccaagtagaacggtatgaggcacgccagtgcaaaaaatactaccagtattgtgccgatcaggttaaaaaccatcatgtccatggatgccttcatgggcttatttttataaattttttgtccgctcatatattccgcctcctaatataacgaataatcgggatcaacctttttaacaatgaagttaacaagattaatcgtaaagaaacacagcaccgactgatacaggcccgcagcagcagacatccccatattggaggttgacatcatggaacggtaaacaaaggtatcaagcacgtccgaggtctgcagcaatatctggttatctctcaccagctgatagaacataccgaaatcccctctgaaaataccgcccaccgcaagcagcaccataatgataattgtgggcttcagacacggaattgtaatgcggaatatacgctgccagatgtttgcgccgtcaattttggccgcctcatagatttcctggctgattccgacgatagccgccagatatacaacgcttccgtagccggttgacttccacagctttacgataaccatgacaatcggccattcctttgcctgattatagatattgaacttttccattcccatagatgtgagtatgttgttgagcacgccatgatccccgaaaatattcagcataatggtcgcaacaacaacccatgaaatgaaatggggaaggaacatcattgactgggccacttttttaaaatgcttccttgttatctcattcagtataatggcaaagcccacctcaaataagacaccgaaggatataaacgccacgttatataaaagcgtatttcttgtcaaaggccacagcttattggataaaatcatgtaacggaagttttcaaagcccgaccacgggctccccagtattccatcctgatagttgtattgcttaaatgcaagaatgattcctcccatcggtatgtagctgaatacaattaccagaatcagcgccggcagcagcatcagaagaagagcataattctttttgatttttttcagcagcggctgttttcccatactgacagctttttcatttttcaactcattttcctccctaataattgtctgttgattcccggaatcttatttcatagtttacctccggcacactcttaaaatcccgtccttccatcctgtttatcagctccaggcattcatatctccccctctcttcatcacagaaatgaattgccgtaatggatggattgtgatgcaccaggagcgaattgtcataaaaggatgcctgtttaatatcacccgggacccggcagctgctccggtccagcttctggaaaacatatctgcagatacagtcatccatacacaaaattccttccgctttcccgcgtacggcatattcgacggcttcttccgccatttcccggttcagcgtattcagcagaacgatatcttcctgcggcctgagccccctctgccagaatgcttttttaaatcccttgtatctgcttatggttacttcatgacggatatccccgcctatcagcgccagcctttttattcctctgtccaacaggcttccggtcatttcacagcacccctgaataatcttcttctcattcttacttccgattacaacatagggcagccccgtctcttccaacagacataccgccggatcctcccgaacggcccgggtaataatcactccatccacctttcctgatgaaatcaccttcctcaactgcctgatatcttctccccatgtataaatcagcaggatatcatagtcattccttgctccttcttccgtaattccctgaagacaatcctggaaaaaggacatttcttccattttggcatctcccggaattacgacccctatattgaaggtccgactgcctgacagcgcccttgcaaatttgttggggctgtactgcaccgtttctgcatattccagaactcttttccttgtggcagtgctgatacgtcctttccctgacaatgcacgggaaacagtcgtaattgatatccccagtgtcctggctatatcctccatggagagttcggtatctgccgctttctttctcacttgatcaccctctcgtgtttgatttgtatttagcgcaagcgtttgttcatttagctaaattatatatccatttgctaaattattcaattattatattttcacaatttagcaacttaatttttagcaaatatcacgtttttagctgtttaccatatcctccacttgttattcaatcgaaataaatatatattatagggatacggtaactcttttttagcatcgttttttcataatgcaaatatttactatcatacatctgccaggatgctaaatttttgccaaatcattaaaggagggttttatgggaacttttaaaaatcttgacaagctgctggactcttttacacagggatctattcccggctgtgcatgtgttgtcatgcagaatcatgacatcatccatgaaagctattccggttatgccgatattgaaaaggggagtaaaatcaacgaacgctccattttcagacaggcgtccaccacaaagctttttacctatgccatcggcatgatgctgttcgaagaaggggcgttccgttttacagatcctgtctatgattttcttccggagtggaaaagcactacaaaatacgtacaggttccgggacgcgctgcggaaattgtccctgtggagcatcccattaccgtaaaagatgccttcaccatgtcctacggcctcccctattgtatgagaccacttgaccatgtgacggataatcccaccgtcaatgccatgtccgaagcggtcaggccttattgcaaagacgggaaaatccccacactgcgggatgaggtccgcgcaatgggctccgttccgatcatgtttgaaccgggaacgcattggctttacgggctgggaagcgaaattgtgggggccattgtggaagtgataaccggaaagtccgtacggcagaatatgaaggaaaggctgattgaacctcttggcctgaaagataccgccactttcctggacgatgagatgatgagccgccttgtcacctgctactttatctctccggataaaagaaaagagcctatgcccgcagatatggacgacatcctgaagatcggcggcgccccagaatattccagggcaaatctgaactgcagctgcagagatttcgccgtatttatgagtatgctggcaaacggcggccaatacaagggggagcagctcctgggcagaaagacgattgatctgatgaggaccaatcagcttgggccggaacagctcaaagatttttggcattataatggtgtggatattctgggctatggctatggaatgggcgtgcggacacttcttgacaaagcgcccggcgcgtccaatgggtctgtcggcgctttcggctggtccggcgggtacggctcctgggcggaagcttcccccgaggatcatctttccatcgtttatatgcataatacacagggtgaacacaatgagctgtttcatgtgaaggtaagggatgttgtatatgggtgtattgaatagaatgatgtaaaaaacagcggagccggggtctattctttagcccacggctccgctgcttttaatatttatactcaaacacttctttcccaaaagcaagcctgaaatcaagcaccggacactcctccagtatttccggcacagcagcatcccggaacttcatcaccgctttatgctccttcctgtaaggctcccatttcggcagcggattcccattatagtccacaccgttaggatccccgtatttaacgaaatttgtccaataagaggtcacctgcctcgcaaggtcatagtgcttcccttcaaaaggcctccagctgtttcccagagaatcaaacatgaaccacagatccgagccgtggaaggagcccgcatcatcccccggaatgtcatgatcaaaaatataataatacaccttcttacccatggaagatcgaagctcacagaagcctctgctgttgcttaacagcatattttgggcatctgtttttgtcagcgcttctgcttcttcatcattggagacgcctgcgatccgtataaattcctcttccctgtcaccgaacagcttcgcccatttacggaaatcttcgtaagtgaagctgtttccgccgaacatgcctccctgggtctcgccccagcatacgccgataatcatagggacatcaggaagccggtcattataataggaatcccacacagattcttttacaaacctgccgtcaatgcactgcccaaatccgaatctccagtcagaggaaatttcccgcagcttccccataagaaccgaagcgtccatttcctgcgcctgcgccagattttcaatccctgcctgcctgaaaaaatcctcgccatgggcttccgcttcccgcagaggcatggccgccccaaagggcttctcttcatccgcaaaagccatggatatcccggactggcagattgcgccggcaatgatgccttcattgaagggactgcacagctgggcctggacgcttccagcaccggcactctgcccgcaaatcacgatatgatcgggattgccgccaaatgctctgatattttcatgtacccagtgaagcgccagcgactgatcctgaaaaccaaagttggaaatcacttctccttccggagtccgcgccgtgatctcagggtgcgccaggaaaccaaacaatcccagccggtagccgatcatcacgacgataacgccgcggcgtgccactctttccgggtcaaattccacctcatagctgtagccgtcctgcaggccgccgccgtggatatagcagaatacgggaaggttctcgtcttctgccgctgcaggagaaaaaatattcagatacagacaatcctcactcatgccataatctgccgacgtgggatgcagctcttttgtgtaaaaatcatttcccgtaccgggatgtattctcatcatgggcatgtctccatactcatagcattttctaataccctcccagttttctgccggctgcggcgctctccagcgaagctcacccaccggcggttttgcgtatggcacccctctgaatacagtaatacggggatcctttcccaccagtccctgaagaactccgtttttcacctgaacctttcgtaacataattccccttcctttctttcataaaaatacagacaacagccaggacaagccttagctgccgcaagttctggcatccgcgcctattcgatggtaccttttttttccataacaagcacattcaccgaatgggcaggcgctgtatagacaaattcacttccgccgaaaatactcccgattaccgcggaaacatgctccttatcctcaaaggaatttacctcccacggatccgctgccagcacttccgttaaaacagcctcctccaccgcacagtcagccgaaatacttatctcctcttcctttccgctcacatttactattttcagatatatcttattcttatcctgggttgcaacggcattgattaacggatgaagcgtatgaacttttttctgcacaagctgatcgtttatataacactcatagccgtactcattgcataccattttataatggttatattccccgtaagggatagatacagtaacctgttcttcttccgacaaaggtttgtcaaaaaaccgcggcaccctgaccgcgctcctgccgttctctattttccatacctggttcctcacgcttcttgtcgtccactccgtatcctttggctcattgcagcctgcgtccgtctccgggtggtgattccagacagataaggtcagcggattgtcctcttcggttttaatatctacctcaaaggtatactcctccagttcttctgttccaaaaactgcccacatgaccggtttttcatgaatgctcccgcttcctataaacgtttcgaaagcctcgttccactccctgctctttccggtaaaatgatgcctccggtttccgaaaatcattttccagccatcgtcagccctctcaacctcaccatagatacattgggaaacctccacgggctttccgttcacttttgtatttttaaaaagcagtccttccttttcgcacataatgccggaaattccacggtataccggaggctgttcttccccttccttctcgatttccaccacctcgtcgcctctgtattttccgagaagggaaaccgcatggcagctggggattccatagacctggtggttgtcaaatacaatcatattcggcttccaggccgtataatcggaattctggaatagcggggcataggccgtcagccggacaatatcctggttcctctccgcacccaaaagaaaagccgcttccgcaagagcgcattccatggaagcgatggtatttccgccgtttaccgcatattcccccaggaaaattttcgggccgtttctgtcgtaatcatcgaacaaatccccgttttccaggaaaaattcaggggcgtcataataatgctcatccgcatagtcggtaggaaggttttccctttccgtatggccgttggaaatatagattacctgggggaaagcttcctttagcgtcttataaaacagctcatagcgctgattgtattccgggccgaaattttcatttccaatttccacgtatttcagccgaaagggttccttcctgccgtttttcgcacggaggtttccgtaaggggtatcggcagagcccagtgcatactccaatgcatgaagcgcctcttccagatattcttttgtcgtctcttccgaaaaaccgccgccgtgacgcgcctggcagctcatcccgcagttgcagacatacatggcctccatttccaagtcctcacacagttgcagatactcatgaaaaccaagtccgtttgtcgtacggtaatgccacatcagctgcgcgctggggcgctcccacacgggccctatcgtacgggaaaagcgaagggcgttctgttcatttatcccctccaccacgcagccgccggggaaacggataaatttcgcatttgtgtttttaagggccattgccagatcttcccgaagcccatgtcccctgaacgttttttcaggcatcagggaggtaaaaccaaaggtaaccgtgcaggccgtatcacaggtgaggctgattctgcctttgaaatccgtgcccacggctgtaagttcacagtcataccggcggtagtccgtattttttcggatcgcaatttcacagctgcccaggtccgttccttcctctgactccaatgccgctgtaaatgttgcatcagcatcggactgcgccataaaatacaggcggtatcgatcgccttctttcacaggcacaccaaaatagccaatattgtatatttttcctccaggttcaaaggttacctgcagggccgctttcctgttcggattgagtgtgccatccttcaaaagccggaaagacgccttcttagcgtaccagcccggaatttccgagggcggaaccgcagccgcccactcatccatgccctcaccgtgattgaacgcccccggccagccgtattccgttataaaaattctctggttcggatcggtggtacagccttccggcaccagggaatcctcaaatgccctgtttcggatcatttccgggtacaggcctccgtcggcagcatggtttatgtcctcaaaaaataaaccgtaaaactccggcgcagtggggcatttcaccttcttcgtatgaatatgtattgtgtttttcatttcagcccccgctctttccaaaaattctctgcataaaggcatctgccagaggcagccacagctcaaaattcggatactcataattgccgaatacggacacacccgcctggccgtgaggcacaccggtaaaggtatgtacctccgcccggatgccatgggcaagcagatccccatatacccaatgcaggttatccagcgctttgtcttccatgcctaccgcgtaaaatacaggcggataaaccacctttgtataatccatttcctttccctcccagcgagggccgtaaatacacaggaacgcgtccggcgatcctgaatatccatccagttcatccggagcataatccggaaaatgatccgtcaccttctggttcccggaataataacggatacattcttcgccggtcaggccgccgttggaaaatccggcaaaggccacctgattttctctgatgcggtattttgatgcgtcctttcggatcatgcggatcagccttgccgcgtccgcgccgcattcctgtccggtgtagggcatcatgtttgtcctgtttaaaagcatgaagctctgatagcccagtctattgaaatccaggcagctctggtacgcttcatgtatcacgcagtccccatggtcgcctccggcgcacagtatgacggctcccttcggagtcacattctcaggcagaaggaactcatacatatatggccggaagtccggatcatggttataacggaagtccggattttccagatattctcctgtagccggcatattcccctccggccatagataaatacgtgacggcgcatccggcagtttacacaaggtatccataaattcctgatattcctttgccagctccagctgctttgcttcttccttttcccccagcatatttcttctcatgccatgaagctttaccagtttttctatcggatagcagggcgcatcctcaaaataggcaacgctccggtgctgtaaggcgctgcagaaccgcgcaacgttgttatctaaagtttctgtatcacgattcatgaatttccctccccaaagtgtagccgattctgaatttcataagtgcgtctgcttttacctttgattcctccggtttatccgtaaactccatcacgaattcattctccgccgtaaaagacttccattccgggagttcctcccctatcgtatctttaccgttgggatctcctgttttaacaaaattggcccagtaggagctgacctggcgggcaagatcataatgtctgccagtaaacggacgccagcatcttgccagactgtcataggcgaaccacatctcgcttccgtgatagctgccggcatgatcctcgccgggaatatcggcattgaattcatagaggtatgcctttctgtcctggctgtcctggatatacccaaacatccttaagcctgccgccagatcaagcatggcgtttccggaaaacagagccttcacctccgcatcattttttacaccgcaaagagacatgaattcttccgctttgtcactgaatccggcggcatattccctgaatgcagccatggtttccaccggtcgtgtgaacgcctttgcaaaggactccgcctctccccggttatatcccgccagcaccggtattctgtgatggtgattttttttataggcttcaaaattggattctcttatcaaaataccgtcaatagcgggttcaaaatgaatcccaggccctaaaagcacgtcctccagccgtaccagttcttcccccggaagctttctggcctctttcaggcttctgatcccggccttttcaaaaaaaagggtgccaaccttttccgccttttccagcggatggctcctgtcttccttttccgcaaaggctgcggttatgctgctctcaataatggccccgtcaatcagcccctccgccatgggggaagtcatcagattctgtacgctcatggctcccgcagactgtccggcaatagtaatctgagccggatcaccgccaaatacagcaatattgcgcctcacccactttaaggccgccaattgatccagagttccgtaatttcccttgggatcctccggcgcttccgccgataaccaggggtgggctaaaaatcctaggacacccagacgataagcgatcgagacgaccacaatcccttttttcgccatatgctcccagtcaaattccacctcgtaaggatatcctcccttaaatcctccgccatggatatagattaaaaccggaagcttttcctctcccgtcctcgccgtggtataaacattcagatacagacagtcttcactcatctcgaattccatgcctgtggggtggatctcccttgtccagaactcctccgtgttgctgccgggcacaggctggcaggcgattgggccgtactgatccgcttttcgcacaccctcccagggtacagccggcaaaggcgccctccagcgcagttctccaatcggaggtgcggcataaggaatcccgcggaataccgcaactcttggatcccacccatggattccctgtaatttccctgattccactgttacctgtaaattttccataccttctccttttccgatttttgtaatttatttttatcttcaaaacaattgccggccatagaaatctacagccggcaacacattttattaattctttacctgtttactgtgcagcaagccatgcatcaaactgtttctgctcttccgcaatgatctcatcgattcctgcggccttcagctcttcgttaaacttttccagataagaatccacgtctaccaggccatataacagggcatctctgtactcagccacaaccgttgtgcaggctgccatctgatcatataccggcgcactgtcgaatatgaagcccattgcttctgaaaatttcgcatggttcggggcatccagcatatcggtataataagtggacatttccacctccagaggaagactcaggcactgattcggataataccaggggccgttcatattccaggttgcattgctcgcatccacaccttccgggaaacgggcgataccgttttcatccaccgaatagttgtggccttcaataccgagaatcatatagcgcgccaccacttcgtcggttgccatcaggtacagaatcttcatggctgcatccgggtttttgcatactgtggagaccatccagccgcctaaaacagatgagcttgttcccaccagatccgtaagctggaactctatgggctcgtaggggctgtaggaaatcagcgccttaatatagtcggcgctgtaaccgccaagataacagccggcggctacgccattgttatactgtgtgatagttctttcgttattcagaggatcatccagctgcaatccggcctcgttccaatccttcatcagatagcagaaatcacgccattcctgcgtctcataaagattgacgatttccgtcgttcccactccctgatttaacaggacgccgagccagttgggattgcccaggctgtctatgccgatgacaggttcgtcattggtattcaccatataggaaaattccggatgaatggcctttgcgtctttcatgatctgtgtcagttcatcaatagttatccgttctccgtctctgtcggcgattcccagttcctccgctatttctttacgcagcgcatatacctcataggtggcatagctgtcaacggagggaaccgcatattgtataccggaaacctgctgggtttttaataccttatccggatacatttcccaaagatcgggatacacatctttataaggctccagagaaatacactgctcattcttcacacagctgtccacattggaataaaatctccagcagaatatatccagaggattctggttatcggacagcatcagtgtcatctgtgtggcaaggtcgccaaagttaattccgatcaaatccacctttgcgcctgcatttatcgataccagatactcattcagcgcttcctcaacctttgcctcatccggcatatcatagcttaatgactgcacggcgattaccggccagtcgtccgggttttcgggtacttcaagcgccccggccgtttctgctcctgaggcggcggtacttccggcagaatctgccgcacccgaggttcccgtcccggcaggatccgaaccacagcctataagtgttccaagcattaccgcagcaaggataagtgataccagtttctttttcatagtgcttcctcctgtatttcatttcataaatctatcttatatttttctttcttttcaaaatattcattttccgatataatccgtgatattttctgactccggacaatcgttccgacgaaacagaacggttacagggttatagcgccggacaacgatgcgcggacatatacatccgcaacagccgcttcaataagggcctgcctgtctgatatctggcgtgggctcagattcagtatctgtctgcctcctctgataggaaggatacactggctgtagcctgtaaaattgtaattattgtcaatgggaatcagactatccattttctcccagaagcccatccccatttccgaattggcaaatatatgcgaaaagcctcttcccgctgccaggatagtcccgtcctttcctcccttgttaatccaggccacataaggcgtacccgtaagataacttccgtcaactgcaactatcggatttcctataaaatcaggttccccccagtcatccatggaatcggaaatcctgaaataaacagggattctgtcctcatttaccatctcataaaccataatgaacttcccgttcggcaggtaagccacgacaggcattcccgggcgaaggttcccgtcgggaaaagccacgtctattttttcctctccccatgtatagccgccgtcctccgacaccttatgtgcaagaagctggttataattcccatgatccttgtaccgctcatccgaataataacagaacagccttccgtcaggggactgcagcaggaagggctcccatacgggaaggcccatgatatgcttttcgtccctctccccttttacaatttcgctgacaaattcccaggttttacccacatcttcgcttttatacatgtgcagtgtggtagtgctcatatccttgggaataatgttgcctgcgcacagaatcgtcccctcctttatcctccccatatcacagggcagttcaaacagatgaggctggaaacggcatccctgtcccagctgtgtatcctcaacacagctcagataatgccagctgtgcgcatcatccgtactctcataaacaggaaaaacgggagtcgtctctgtgtaatactccatcgtcgccagcagtgtcccgtttttctccccgttatgctccaggcaaatgcagcgcggatacatagaacccggacctctctgcccttcaaaaggctccccggggcaaaacaccacgcttgtatatcttttctttaacagaatggaacagcttcctccctctttcggaacatgcccgccattaggggcataaagagaatcatgaattaatttactgtctgcagccctattcatatttaactcctttcacctgcctgcgcggttcccgtcttcctgtgctgtctgcccctcttgcccggcctgccaccctctccgtgtggtctgctctcccagtgcgggccgccgccctgtaaggattcctgtaaggggcgtcataagcacgccggtccttaggctgcgttctttgcagccttagtaccgctgcgtgattatccgagcggtaagcaaaaacgactaaagtcgtttcccctctaaggaaccttacagggcggcggcccgcactgggagagcagaccacacggagagggcggcaggccgggcaagaggggcaggcagcacaggaagacgggaaacacacctcagtctgtcagccctttacgccgccgattacaatgcctttaataaacgccttctggaagaagggataaataaccataatcggtacgacggaaattaccgcaattgccattctcactccggaggtggggatctgcgtggtaatctgggcgctgcccgcgtccagcgtattctctttcaggaactgcacattattcatcatggaattgagcacgttctgaatggaatacagatcgcttctccttgtcagataatacaggccgttaatccagtcattccaataagccagtgcggaaaacagcgccaccgttgaaagcatgggcttggaaagcgggatcgctatccgaaacagcatacccagctcgccgcaggaatccatttccgcggcctccagaatatccttgggtacattagtagtgaaataagttctcatcagtattacgttataagcccccagggccaggttcggcaggagcagccccagaaggctgtcgcccacatgcatgtactggctccatataatataggaaggaaccataccgccggaaaacagcatcgtaaagaaaatgaaaaaggataaaaaattccttccgggcaaatcctgtttggacagcagataagccataaacattgtcatcgtcacattcagcgtggtccccaccgccgtaatcagaatcgtcaccccataggctctggcaatctttccggcagaccggaacaaatactcataagcgcggaaatttatttttttcggaaaaaaggaatatccgtaaagcgtcagtgtagcttcatctgtgatggacgccgtaatcaaaaggataaacggcagcagacagcacagcattaaaagaatcattattatattcgcaaatatgcgaaaacctttattcgttccagccatttttcctcctcctcagaacaacgcactgtcaggttctgttttacgcacaatagcattggtcagcattacaacgaaaaatccgagtacggactgcatgaatcccgccgcaagcgatcttcccacatcatgatcctgcatcagagtacggtatacgaaggtatcaattgtggtggtagtggaataaagcagtccgctgttctggggcacctgatagaacaggccgaagtcagatgcaaacatcctccccagcgccatgatcgtcaggataattactgtaggctttaacagcggcagggtaatccttgtaatctgctgccaggtagtggcgccgtccactacggccgcctcataataagtcttgtcaaatccgataatcgttgcaaaatatacaatgctctgaaaaccaaagcttctccaaagctgtacgatagtcagaataaaaggccagtactttgcctccgtgtaccactggactccttcttttcccaacggctccagaatccccttgttgacaaaaccgttcgtgctggacagaaaggcgtataccaaatagccgataaggaccgtgcttaccagatggggaatcagtattgtcgtctgatatacctgctgcgccgttttcttacgtacttcatttaaaaggattgctacgaagattgcaaaaacggtccccagagacaggaacaaaatattgtagccaatggtattgcggaacatgatcttagcccatttggagccaaacagatatgtaaaattactcaggccgttccagggacttttgattattcccttggcaaaactgtatttcttaaatgcaagaatcagtcctcccatgggaagataattattaatgatcagatacagaaaccccggcagtgcacacagatacaaaggggcatatttacggagttttctcaatgtctgcttctttgaagccgcttttctttgggttgtgcctatattttttgacatcatcttatcctatccttccattcagggaaaataatctattgtacggcaagccatgcatcaaactgtttctgttcttccgcaataatctcgtcgatccctgccgccttcagctcctcattgaacttttccagataagtatccacatccaccaggccgtacagcaatgcgtctctgtattccgcaactactgtggtacatgccgccatctggtcataaaccggagcgctgtcgaatacaaatcccatggcctgggagaattttgcatggttcggggcatccagcatatcggtatagtatgttgtcatttctgtttccagcggaatgctcagacactggttcggataaaaccacgggcagtcctggttccaggtgctgttattctgcgtaacgccttcgggacgtctcgcaatgcctttttcatccacgttataatgcacgccctcaatccccaggataaagtaccgggccaccttttcatcagtggacatcaggtacagcatcttcatggcggcatccggttctttgcatacggtggaaatcatccatcctcccagtacggaggcgctcgttcccaccatatccgtcagccggaactcaatgggctcataagggctgtaagctatcagcgccttaatataatccgggctgtagccgcccaggtagcagcctgcggaaacaccgttattatactgtgaaattgtcatttcattgttgagcgggtcgtccatcattaaaccggcatccttccaggccttcatacgaaggcagaactcacgccattcttccgtttcatacaaatttacaatctctttggtatccacgccccgattcatcagaacgcccagccagttgctgtttcccagactgtctatgccgataaccgcttcattattggtattgatcatatacgcgtattccggatgtgccgcctttgcatccttcataatctgagtcatttcatccagcgtaatccgttccccgtccctgtccgcaatgcccagatcctcggccacatcttttcttaacgcataaacatcataggttgcatagctgtccacggaaggaaccgcatactgcacaccactgatctgctgagtcttcaggacaatttcaggatacatttcccacaaatcaggataaacatcaagataagaatctaacgggatgcactgttcgtttttcacacacccatccaacgtggaatagaatctccagcagaataaatccagaggttgttgattatcagacagcataagcgtcagctgtgtggagagatctcccagggtcatctgcaccatatcggccttcacgcctgcattaatagataccagatattcatttaaagcttcctccaccatctgttcgtctgccatttcactcagcacaggcacctgtaccgtaatggtgggccactcgtccgggttttgtgctgccgaaaaatctccggccgattccattttttccgtctccatctccccattaccggtcgtttgagactgtgctcctgcaggcgccttttcggcacagccggccagcacacccgtcattacaaccgtgagaatcagtgacaataactttttcttcattgctttacctcccctttttccttttggtaatcctattctaatcaacccggggagtgaaaaatatgcaaaatcagagaacgtttattgcattttctgattcgaggccgccttacggtactccataggcgtacagcccaccagctgtttaaagctccttgtgaaattggaataatttccataacctacatggctggatatcaaggttacaggcaatgaggttgttgatagaagcattttggcagactccattttttcatttacaatatattctttcagagtgcaacccatattctttttaaaaagctttgtcaaatactccgggttcattcccgcaaattctgcgatttctgttaccgacagatccgtgtccagatgctgtctgatatattttaccgtttcccggatcacatcctttgtttcccctttccccgtaatctcctgcagctttaccgcaatatacgtcagtgctttttcaaacaaatcatatccctgccaggaattcatataggtcaggtagggcagcttgtcatcaaaaatcatctcgctgccaatctgatgatttacaagatagaccaataaaagctgggtaacgctctgatgaaggttcatcatgccggatgcattcatatgtccatggtaatcttttgtgatataagaaaggatactatccttaaagacaagaaactgatcctgatccaacagctttttccatgtacccagctgcagcctgtaggaattgctgtttacatccttctcattttcccggggcagaaacacacggctttccctgcgcacattatcccttttcgcctgaaataaaggctgcgaatatttcacaagctccgccgggccgcaggctctgccgcagtagatagccattgaggtctgaagggcacggaacgcaagaatacgaaagctctccagtttttcggaaagctcctctgtttcataggacaattcccttttccagtacaggagaatggcaaaatccgtactgttttctttcagaagaataatactgaataccttcaaatcctgaaacacttcatccagaacattctggtaaatcagacgtaagatgggcttttctatcttttccagatgcttctgcgttttgagaacctggatcagtacgggcagatattccgattctcccgcgccgttaacattatggctcaaaatcagcctgcgcaaataggagtcctcttcattccgcccttccagatactgcagggcacctgtttcaagaatactttcctcatatgtctgaaaaaaagcgcccatgtttatcagttcctgatttttccgctctatttttatctgggaaacggcccgctctacaacattcttcaattcctgtgtactgacaggctgaagaacataatcaaagctctgcatggaaattgcttccttcatgtatttgacatccgcataagccgtcaggaaaataatcttcacatcgggatacctttccagtacccatttggcgaaggttatcccgtccgtttcaggcatgacaatatcgcagaggaatatgtcataatgatactgtttcatccattcttttgcttcctcagcgctgtttgcagtatctattctctccatttccagtttcatctcttttagctgggagtccactgttttaagcactgttttttcatcatcaataatcagtatgttcatttttatacctctgtatatcgcggattttcccacgcctgcctcataaagcagtctggacgggtttttcaaacattacttgcggaagcaatatttccgtaacagctcctccggcgggactgttataaaaataaagctttgccttatcaccatataacaaataaatccggtactttatattatcaacaccaacctgcatggaatgatactggaattccgtaaccggcctgttcagctgttccagctgttccggcctgtagccctctccattatccgtgatatggattcttgtataccatttcccgtcatcctctattctgtccgccgtaatggaaatagaaagcaccctgctcttattcaccgcatattttacagaattctccacaaatgtctgcacacacagaatggggatcttacaggattccgtctcttcctccagattaatctgcagaagaataggcatggcatttttaataatataaatattgcagtaagctttaacctcttctatttcctcagccagtgtaaccagactgtccgaatcctgaaacacatagcggaaatgcctggatacggcaaaaatcatggttttcaccgtgtccacatcattttcattgagtaaagaggctacgatattcagacagttcaggaaaaaatgaggtcttatctgcagctgataatactgcagcagcgcagcgttggcttccttctcctttttgtatttttcctgctccagctgccccatctccgcaatcaattcatccagcttttcattaatcagccggatttcctccagctggctttctttccctgcatatccgaaattttcagacgcctctccccttttcatttccgtcaggcggtgtacgaaatgatcgatcggctggtaaataatccgttttacaaatctgtatacattccacaaaacagcaaaagccgtcagagggatgagaatgaacaacagccagaattccgcctgattccagaaggcaagtttctcatccttatgaatcagcatgacctgaagctcctgtccctccaccgcttccctggaaatcatgtatgtcagccccgcgttgtccgtatcattcctgagtttttccgcaattgtctgcccgtcaagaagcggctctcccagattggcaagaatattcccctgcatatcggagatgatcagctgcatattttccctcaatacaaaatatacggacaaattgaccgtatatcctaaaagctttccccgatctcccagaagatacagaagatacgtttctccttcataggtcattatctcttcataaggcatcttttcacctgtatgggcccgtaccgcctctttgatcgcctggttcaggcgatagctgtcacccgcaaagggatagctgctgaactcactgtgaagggaatcccagtcctgatcgtagtaaaagacgccgccgaaataatccagattatccgccttggtgctgaaattattattcaggtaataggcagcgagcatccactggctttccgtaatctgcggccttttcagcatctgataatgtacattgttcccatacagatttttaacataggcctccatggaaccgatatcccgggcaagctgctgcgcataatcggaggtcatggccgcatgatcccttttatacacgtgccggtactgcagtataatatagcctccgaaacacattaaaagcagcagaagcagaacggaaccgcctatgccgcctatgaataagtatctttttatggaaccatttttattcttcagaaccgggacttcctttttgttcatgcatttatttccttctttcccttttctgcatcctccgggcatcaagcagatttgcagctgttgtgtactttcacagttacacagattttatcatataatccattttgaaacaaatcgttacatgctatgccggttcataaaaatattcgttaagaattgatccgccaggacctcccatgtttcaaaattcggatatttaacacatccgtccatcagcttccttcccgcctgtccatggggcacccctgaaaaagtatggatttcaactgtgattccatgtgatataagctcagtgtacagcttattcatattgtctatgttaaaatcctcaagccccagcgcatgaaagacgggaggatataccgccctgtcatagtcgaaggtatcctggttcatcctcggcccgtaaatacacagaaaagcatccattgctccgctgatcgtatcaagcgtatcctcttcataaccgggaaacacatcagacattttctgttctccggaataatactgtatacatgcctctcctgtcagccctccgttggaaaatcctgcaaaggcgatctggttctccttcacacggtatttaccggcattggccctgacaatacgaatggctcttgccgcgtccgccccagcctcacttccgctccacggattcatgttcgtgcggttcaaaaggagaaagcactggtagcccatccggttaaaatccactgccacctgatatccctcacacaaaacggtaaagccatgatctcctcctgcgcataaaataacggcgcctttcggcgttacatcctctggtacaagcatttcatacataaacggggcgaaatcgggattgtgattgtaacgaaacgctgtattgtccgtgtattcagtcaatgcaggtatcttgttttccggccacagcatgattttcggataatcggttctcatcccctctatttttattctcagttcccggaatccgccgagtctttccctgatttcctccggggaatccagttcttctatttccgccgccatttttgcaagctccgccagctgctccacagggtaacacagacattcctcaaacaacggaaccgccgccaggttttcttccccgaacacgcttcttaccatatccattttagccctcattttttcaaacaaagctctcatatcttccatatcatatcctccttctgcactgccagcacctcccggtagggacgtgttgggtcgcattctattctgcattcctcatcaataaccatcgtctcatatgccactgaaaacggattccaatctatctcaggaagggatggactgccggttctggcaaaggcccccagaaaagccgccagttttcgggataccgcttcactttcctgatgcagtacaatacgaagctgaaggggaagctctgccccgtgccatgcaaacctcttatccggcatgattctgtgaggcgcatcgtaagccgtcaggtaacggtatacctttcccctgttctttgccgcacagactgccgaatgttcaaatgtagcctgttccagcggaccgcatatcgtacatactttcataagaagatgggcattatcattttctttcctgtcattctcccggaatacccggattaattcttccgccccggaaggactgatttccctcagatgcatccaacccggtccgcagccgtttacaatagcccgaatcatttcttcttccgtccggattttatgctcctgttccgaagcgaacgcagccagttcatcctccgcggaaccgacaataatcgggatatccggattcaccatgggaaaaccgttttctgtgttaaaaggcagatgaatatcgtcagccaccggttcaaaggaaaaaggacccagataaaaggcggcaccgcatatgtgtgaagcgggcagcgcctggagcctggaaataatgttatttctaattcccagctgaaacagaaaatgctccgtcatatcaacggccttctccaccgaatatctgccgggcttcccaaaagcactttccatcacggctccttttatcagcgaagcggtttccggcatggcaagcagagacgcaattttaactcctccgcctgattcccccataacgatcacattctccggatctcctccaaaaaatcctatatttttatgtacccatttcaaagccagcaccagatccgtaattccgactgtgcctgattcccgaaaagcttcatctatttcacccagataaagaaaaccgaaagcattcagcctgtggtttactcccacaagaacaatatcctgttccctcaccagaccatccgctcccaataccgtagtccccgatccggaagcgaaaccgccgccatgtatataaacaattaccggcctttttccctctccaatttgcggtgtaagtacatttaaaataagacaattttctcctttcggctcttcagctatcccgaaaagctccggtttcccgccgctgaaataattgccgaaatcccagcttcccgctatactgcccccttcctgcaccgcaatgggtccgttttttctgcagtcttttattcctttccaggttttcggctcccctgcgggaaggaaccgcttatccccgtcacagcttcctccataaggaattccccggaaaacagccactccgttcctattttctcccatcacctttccataaatcgtatcggcaaccggaaactttgcggtcactctgccaaatacaggaaatccatatcgctctgccattagtgttcccctctcttattacggaatcgcggaatccattgcctctgttatgattgcggaagcatcctccggcataaggaatccgctttgaatcattttcataacagcttccaccaccttacgcacatagtcctcatgtgaagggtacatctttttaagcttatccgccggaaaaggagaaatgatattacggacatttcccggttcatccctccaggtataggtacagacagggacatccacatagggggagcggacgccgcctctgggatttccgtgctcgtcaagcacgaaatccgcatccggatattcccccatcatctcgatatatgctgatctgggagcgggaaccccatattttatccattttttcagatgatccaataccgcccggatcacataatgaaacggaatctctccgtagggacgttccagcggatactcttttttctctccgccaattttctccaaatcctccgcacagggacagcatcccatatcccagtccattcccaatgcggctcctgcgatttcatactgtctgtgctgccgtccgggaagatcgctgtccggccagcggtacatataagaatagcttggatgcactcctcctccccgcatatcccccatggtctgtgtccatacaagcggcacattggtcataattttacacctgtcatcatcggcctcaaagcgtgtctcgccattgctgataaaacccggatagcccgtcatatgtatatggaagccatcaaaacacggattatttccgtccgttactgcgaacggctgaagggccgctgcgtaaagggacaagtcacagcccgaagcacccatgcctatcacatatcctgctgcctttccgcagataccgccgccaaacaaaggattttgattggtcttcgattttaagagagccgccacctggctcagggcatcatacgcaaggccgttctcatattccccggcctcatccgtgtccgcaacgcccggcatggctcctccccgctttcttttctcctttggtaccggattgggaaaaccaagagccgcatagcgtttggtgtcaaattttttcagattgtctatggcgctctgcttcatggtaattcccacccatacgtctcctctggaaagcatatattcaccgcagtacccccagcccgcaaaagcacgctcggccccggcgtagttgaaaacctccaatattgcaaaatcactctgtttctgcggggcggcagggcggcgtattaaaatccgcgtacagtatctgccgccgctgcaccgtattttcggatacaggcccacatcatgatattcatacacattcgcatagccgctgacaatgtattcctcctccacatatccgaagtccgccagattcaccggcttctgctgacgccctgcggcgttaaaggggtacgtttctccactattgggaagcggcccgacaacctcgggaagaggcgccggtagtttttgtatttctttcagttcttcataataaacaggctgcctcataagtgttcctttctatcatccgcgcagggaaccagttttttccggaagaaatcaagtacgatatcatagtagccctgtcctttaaagaagccgtgcccctgacggggaaccagcacaaaggtggcgtcatggccgtattttagcaatgcatcatagtaattataggaaaattccggtgacaccgcctggtccgaatcgccatgcatcaaaaggtacgccggctgtttctgatcgacatagaagatcgggctgatttccatggagagctccggcgcttccctgccgggcctgccgaacatctgcacaaaaattttctcctgcacttcatccctctgcttttcctcttttccctgctgtcccggcatgagagtcagccggattccaagctcttttgcacgggcctgcacttgtggacaggcatatgctcccatatgcgtcatatcaccgccgcagtaccagtcacagactgctttaacctcactgctgtattccttccaaccgccgttcccctccaggcggggattcttataggaagccccgaccagcgccgccagctggccgcctgccgactctccccagataccgatacaatccggatcaatgcccagttctccggcatgtgcctttaaaaaacgcacggcacatttacagtcttcaacaggggcaggaaacggcttctccgttaccagccggtactcaatgcttgcacagacaaagcccatatggcaggcctgtaccaaagcatttaccggacggtattttttcgtcagttccgggatgctccagccgccgccgtgaacccagatgataacaggacgttttttctctgctttttccctggggatcataaggtcaagatacatggggtgatcccctcccattccataagccacatcctcataaaagtcgattccctggttttcccagtccattttaaattcatctgcaacacaggtttcttctccggataattttatcaaatccaacatttcgcagcctccttaaccttaaattttatttatattgtatccattttaatataaatggagggaaaaaatatacaaaaacagattctctatatcatattttctgatatatatactataaaacaaaaataccctcaagcagatttataattcctttcttctacttgagagtatccttattctttcacttgctgattcatccgatatattcggatgaaccatcttcaagccgtctatatttacagaaaaattcatcgtaaatcatcattgaggtttcaggcgtaactgtatgcggccaacggtctatgccagtaaaccggacaagcgggcggtgctccttgtcgtatgcgaccagatgacgatatatcccactcgtataatgtgcagcatgagcatagtctgcacgattacaggcgcaggcgttctgaatggtattatagttacctgtccccggctccagactgtccgcttcaaacaaatcgcgctcccccattatataccagactggccggatcatatcatccggcatggggggtgcaatttttccaggatacatagtagcttccattgctccaataccagcaaatgctgcaaacaaattcggtgcctcccgcattagcttttgtgtcataccagaaccattggaatgtccggtaacatagatacgggttttgtcgataggatagtcttttgtcatcaattcgacaacctttgtaagaaacttcacatcatccgtttcctgcggctgcatatctatgaaactactccatgctgctgtcggcaccatattggtacgtaaagacttatgggtatatcctgatggaaacgcaacaataatgccccgttcttctgcaacggcctgccaggaggaattttccatgtaaaatgcccccgagcaggaatagccatgaatagccatcaccataggaaaggtatccttcaaattctttttgtaagcagtcggttcataaacgtaccagtgccttttcaggccgtcaatcattatttcccgtaagataagcccgcatgccccaggggatatagtcctgcgaaggtgaccgtttccagcccctccccacctcttatatttagtaacgaacgcaagcatcttttcagccagttcattccctttctccgggatggtatcgcaataccaaacttctgctactggttgttcattcacgcagagatgctgggtattatatctttctttccaaaccctggctacagaattggacaagtcctcttcgataacatgattcacttttttaagataattgaccagcggcagtgcctcttctgagccatctgctatccatgcaggaatcgcaacatctgccttggtctcatagttattgccatttgtaggtaatgcagcgattttatccagtaatttttctgatatgtctgtcttgcccaccgctgcgaaggctgcaaaggtggaactaaacagaatacccaataacgaagccagcccggctccacaacccaatcccatcacataaacagcgtcataattggcagcataatactggcagctccttgcatgtgcataaggaccgcgcaaaatactcagcagatcctcttcaggatgttccagatcccacttttctgccggaacgacaaaataagcagccgtttcatacttttccaacaagttcttccagtcatattgctcaaacatatcctttgaggtctgtccatcgtctccaataataatgatcgaattgccagaatggcggtaacttttagggatataaaaagaataacaaaccatatttccgtatcgatccggcgattcattttcaaaatatccattaagtaccgtctgatttggtttttccggatcaacagccggatattctggttgactattcgcataaggcttaagcgtcggcagccaatcatccagtctgtggaattcttccgtatacaaaatatttactcccatattttattcctcctcttatctttcatgctaaataattcttttacattttaataccggaagtagcaatgctggcaataaaccacttctgtccgataataaacgctacaattaacggcagcgttgccaacatgctggccgccatcatagtaggatagtcactcatatgttctccctgcagacaggcaatgcccactgccaggacacgctgcgaatcggctgatgtgataattaacggccatagcaaatcattccagcttcccattagcgtcaatatagcaaaagcggccaacccgctcttacatagcggcagcatgatgttccaaaaaatacgaaaatacgagcacccatccagccgtgcagattcttccagactgcgcggaagcgtcataaaaaactgtcgcagaaaaaatacaccatatgcattaaataaattaggaattacaatacccgccagacgattgatcagtcccagatctgcacacatgatatatttaggaatcaacgtcatttgtcccggaataagcatggatgcaagaacaagtaagaaaataacgtctctgccaggaaaacgtatccgggcaaaagcataagcggcaattgcgcatatgctaacctgacctatcacactaaaaaaagtgacaataatagtgtttttgtaataagtcaacagattcagcttagaaattgtttcagtataggcatcaaaattcagacgcgagggcagccattgaatcgggactgcaattgattccgaataagtcttaaaagaagtgagcaccatccataggaacggaagtatcataataattgcgccaattaccaaaacaatataggctccaacatgatgtcttcccatataattttttttcctgttagctggtgaaaaagttctattactcatagtacacccaccttctctgccccaccatctggatgacagttaatataaggatgatgaaaaaaagaatcactgcttcagccgagccatagcccatctgaagattagtaaaagccttctcatatattccatataccattgtgcgtgaagcattcagaatcgggccggaggctcctgcaccgaggaacatataaattaaatcaaacgctttgaacgcaccgattaacaacatgattaacacaaaaaacagcattggcgataccataggcaatgtgattttcaaaaaactctgccagcccttggctccatcgatttcagccgcttcatagagttcaacaggaacactttgtaaaccagcaagcagaataataatgttatagcccagctgacaccatattgcaacaatgatgatcgttgtcataatatattgggggtcacccaacatattaaccgggtttattcccaaccagcctgcgatgctgccataggcaccatattctgaattcaatacacttcgccataccaccgcaatagctgccatcattgtaacgtttggaagaaaataaacggttctgaaaaaggcccggccatgaattttcttgttcagcatgaaagcgataagcaatgacaaagcggccgtaatgggaaccgtaaatgctgtatataccagggtattaataatttctttcgcaaacttaccatcaatgaaaagcttggtataatttgcgacccccacgaattttgggattcctactcctccccatttagtcaaagaaatataaaaggaatgtatgatcggccatgccgaaaaaacaatcattccgatgaccaatgggaggataaaaatatatccccacatcgcttcacgacacatggctttgctcatccgccatttcttatttcccatgtttcaccctcctttatgagaaagagagtgcctggaaaacagcagaaagattcccactgttttctatagcacaaactccactgctctaaattatgattatttactcattttccccttccaaggcttccataactgctttggtcattgcttcctgagcatcatttaagccctcttcaactgtcttggactgaaaccagatattactcagctcgtcagtaagtatctgcccgatttccgttgaattaatcaaatccagtgtttcgatattcattgtatggccattatcaatagactgcaggcaagcttcagcgtttacaccagggaaagcatctgcccacgcctgccccatacccatataggaagggatagctttttccgaaatagcttttgccgtaaactcaccaccgagaaactgcaaaaaagaataagccgcggcaggattcttgctctcgggattcatagcccatgcgcaggtattacacagcgtcagccactccttatcctgcgtggtttcgcagaaagcgacatcatcacccagggattccaccaatccggacacacaccatgagcccatatgtgccattgcaaccttgccggaagcaaacaattggtaattatcggtttcctgttgctggactgctgttggagataccttgtatttatacatcagatccacattgaactgaatagcacgtttccacgcatccgtattcacagcaggcatcccgtctatataatcatgtcctcctgcctggtaaacaaactgtgtacatccaggatagccgctgccggcggctataaatccccaattatcatccgttgtcagcttctgcgcagcatccaacagttgttcccatgtccagccgccttccggatatgctacgccgccttcatcaaagatcctcttgttataggctaaaactgcatcatccatgaacagaggcaccccccaaacacgatccttatatgtgaatttttcaacagctgtaggagaatgtttatccagtgcaattccgttctctgaataggctaaatctgtaagatccataatcatgttattacttgtataatagggtaaataggtactaacaaaaaagtaaaggtctgggccggctcctgcgggcaaggcagtctgcaatttcgtccaatactgtgaaaacggaatttgtgtcaaattgactttgatatctggtgactgtttgttaaattcttccactactttagctatcggctcattcatatattcttcccagtaccagacctcaatttcgcccttatccggatcaccagccagcgtaacgttttccggttcccctgcttccgctatttcagctgggcttgtcaattccggcttttcttccgtctttgaacatcccccaagaatgacagatgccaacatagtagcgatcagaataatacttagtttctttttcataattaaacctcctggttaataatggtagtgtcaagtctgacactccgtttttattaaaaaccttgtattttcagggattataccgctttttgaaaataaaaaagcaatgacctcccctttttggtataatgtagtcaccacaaccaacataacctaaggatggatcattgctatggataacattatactctatttacttactataattcaagaacaatataatactatctgctgcctcctgaatctcatctgcagatattttcccctcagacagtgggccttcgatgattcccactcccctaagtaccagaagttcaccaccgaccgcctccctctcatcaaaccgttcatcaaacaggattggcaattccttctggagtactatctctggaaatacggcaaaccggtcacacccgttcagcgccgcaatggaaaatccatcccggaagatgtcttctgtccgctttgtggggcacctcaccactacctctacgacaacaatggcggcaacggacagtaccaatgcaaaatctgtggacagacctttgtcaccggcgatgttgtcacctcgcctcttcgctttgcatgcccttactgcggccactccctcgtccccaagaaagaccggaagttcttccgcatccataaatgcgtcaaccccaggtgttccttctaccttcataacctctccaaggttgacaagaacctcctggaggaggattacgacaaaaacaagtataagctgcactacctttaccgggaattcacggtggatttcttccgcatggacttagactccctgcctaagaattcctcctccctgaagttttccaaacataacgcacacatcatgtccctgtgccttaccatgcatgtgaacctccagctttccctccgtaaaacggcacaggctctttatgacctttacggaatcaggatatcacaccagcaggtcgccaattatgccagaactgccgccattgtcattaagccctttgttgaccactacgaatatccaaagtcctccatctttacggcagatgagacttatatcaaggtccggggcatcaaaggctacctctggttcatcatggatgccgcttcccgttccatcctcggctaccaggtttcagacaaccgctccgtcgggccgtgcatccttgccatgcgcatggctttccggggcatgaaaaggctgcccgaaaagttccggtttattgccgacggatatagtgcctatcccctggccgcccagcagttcgcacgggagctgggggacagcttcaagttcgacatcacccaggtaattgggctcacaaacgatgacgcggtctctaaggagttccgcccctacaagcagatgatcgaacggcttaaccgcacatttaaatccacttaccgggtcagctgcggttacgacaattataatggcgccaactataacgtggcactctgggtcgcttactacaacttcctccgtccccataagcacaaccactaccgggtgctcaatccggtcgatatgctggagggtgctgacaacatgcctgggaagtggcagctcctgatcctgctcggccagcagaccattctccatttacaggagcaacaggaagccggcagcatctgttcttagattccgggccggaggtaaaaacgcagccatcccgaagggacctgcccttgatggcacgccaaaacaatgctatcatgctgtgacgcagacggtgaaatcttatctgttcttgagttcttcgccgtcggtaagacgttcagagcattgttttggtgtgccgtcaagggtggcggacactgccagtgtctaaatatatctgcaattttcaaggttcatttatgccgggttccccggctatcggttttcataaatcccttgacactaccttaataatggtatagctaagaaatagctacttgattaactgataactcaacaggatggtagaacaaaccaatttccaaacaatcggccagtccgcttcctctttgtttatttttaataaattatagaattcttttaagattatgaatatagaaacatcattcatcctactataaaaatcattcatttagtccaatttgtacaaatccggggatattttatccatttttatttcactttaattatggtacactttgatggtaaagaatacttatctaaaaggggtggattattgtgtcaataaatactgcacagattaagaacatttcagaattacatttctcgggctgccgctctcttccagcttcatcatatggcagtttgttgtacttattttccggaaatatcagcctctccgcacctcagtcttctttgcagataaatgccaaaggcggtgccctattttccccccacacagccacctacacgcttgaaacctcacataacggcgcgacagcattaatgctttccctggatccaacatgtttggaaaatctgcttacatgctccaaagatattttgccatttcgtatcatgaatcaacctgaactatttactgtcacatgccatagcctaagtgaggcggaaaaggaacatcgtatcctatccagccacggatatttatgtttgctgcttgatgtcctccaaagcgaactacagcgtagccagtcagaggcagaaccttatcgacaggctatcgactatatagctgccaatcttcatcttccaccgaccgtatgtaatgtggctaaacatatatctttaagtaatgcccaactgtatcgaattttcatgctccatgccggctgttcacccaaacagtatatcaatgaccagcgaataaccaaggcctgtcgcctgatatgttcttcctctatgccaataaacttaatcgggtatgccataggcttcaaatatgagagttatttttatcggtggttcaaaaatcagattggtattaccccttctgaataccgaatgctaacatgtaccagacaacttccctgaggtaaagcacatgaaaaagcccatcactccatataaatttaaaatcagctttatcttattttccagcttttcctgcctgatattgatgattctgctgttaatttacagcattacctaccaatacttttggcatgaaagttatgatacggttagtaaaacgcaacaacagaatgcaaatgctatccagcaaagtgtaaccgattctcttgctacgctcgattatgtggccagcaatatttccgcttccgattttatccgtgaaaaattttatacttattcccagcaagttgccaacatttccgaaaagaatcggtatctacattcggaaattcgacagacatttcaagagtgcacagactatgccagacaaattgcagggacaaaacaggatcagtattatattaatatttatgataccagaggaaatatcatgggctgcagccgctatgacgggcagcagtcatgctctatttcggaaattccttttttcctccccacactgcagcaaaacggtgaacagtatgtcagcacccttcaccatttcgagtggatcttacccgaaggtacagcatccccttatctttctgtatgccgttccttcaaaacagtgggcagtaatcaagcgattggtattgtcgaggcagcacaggagagcagtaaaatctttcagtttctggataattatccggagtattctgatatcttcatttataatacaaacgaagaatgtatttatccgattacaccgctgaaggaagagtatcaatattactactacaatcttcagatcaataaatatcaacccggaataatgtatgaaatcagcgacttttcccacccggatatccccttgttaatgacctattccattgatccatttcttgatactgtcgttattgtcctccagcctaaaacggtaatatggaattccctggatggttttttcaaggtatacaccagggttttccttttgatcctaatggttgcctttgtcttcactttttcgatttcccgaagattgacgacctctttacgcattcttagtgaagctcttgagaacctgaatttacaaaaggttcagaatgtgccattggcatcccctttcactaatgcccgctgtcattaccgtgaaatcttccagctgcaaaatgcctatactcatatgtattataagttgggacattctatcaatgaaacattgtcattgaaagaatcggaggtcaccagccgcatgcaggccatgcaggcacaaatgaatccacactttttatacaataatatttccaccatagctgccatggctgaggaaggtatgaatgaacagatcgttactatgtgctgtcagttgtccgggatgatgagatatgtagtatctgatctttatcagcgcgtacctttctctgctgaaaggcagtttaccatggaatattggggatgcctgcaaataaggcatgggaacgcaatttccctccaatgggatgtaccagaagaactggatgaaattcttattcctaaattagtcctccaaccgattgttgaaaactctatcaaatattgctccgacgaacttaacttgaaaatttccattaccgggcatattcaggataatcattggactgtcagtatttccgataccggtcccggattcgatcctatgattcgtaacgctatttttgaggctattgaagtctttcgggaaacacatatgttaccctctctgcaaatttcaggcctggcattactcaatatcttcgcccggctctttttgttgtacaaagacgaaactatattcaacattgaaaataataagccccatggaagccttgttattattgggggattgttacatgttgcctcaccagatcctaaaggaggagaatcaaaatgaataaatatcgttgtatagttgttgaagatgaaacacttgtcaggaatagcctgattcggaaaatagaacaactggaaatgaatatccaggtaattgactatgctgctgatggcaacagcgctatgcagaagatcgaagcaaccctcccgaattttgtaattacagatatccgtattcctggtatggacggacttgaactgatgcaatggctttactttacttatccttctattccatttttaattaccagtggctatgctgaatttcaatatgcgcaggcagcaattcactacaatgctgtagattatcttctaaaaccaatatccatagaaactcttagaaaaggaatgaacaatattattctccgatgtgatacaattgcagaacaaattatgccccccacaatgaatcatgaaagccccgaagaattggttgacataatcaaggaatatattctgtttcattaccgtgaaaattttacgttagaaaacattatagaaaagactcattattctcctgcatatctatccagaattttccgcaaggcaacttcacaaacacccctacaatacttaataagtcttcgaattagagaggcaaaacgtctcctgattgcagataaaaatattccagtcggtacgatcggcaatatggtagggtatgatgatgtgtattatttcagccgtatttttaggaaatatgcgggagtataccctttggaatttcgtaaaagcttttcagaacaagaatgaattttcagatgaagaaaagatatctatatcagacatcactgtagtgacagaaagttttatttatcggattttagagaatataaagatatatgccaaaatgcggtatatccgatgcattccaccggtataccgcaaaaaacttcatcctaccaaattgacaaatactttccattcaggcgcagcaatgcctccacaaaaaaataatcgccgaatatcagggatctgccctctctcggctcatcactgtgataggcccctcttcctccgtttaacacaccatcctgatccaaatcccaatttgcatatttttccgcaatagcttttaatatatttaccgcgctttccacataaaattccctttcaaaatcctccagctgctctgccagctccagcaggccacaggccgcacacgcacacgcggaagtatccggaaggaacggttccatcggcgccctgaaatcacatgcggaaatatgccctgttttatccgtgcaggcgataaaataatttgctatttttttggctgctgaaagatattctgcttttcccgtatatccggcgcagagcgcaaatccatatatcccccatgcctggcctctcgaccaggcagaattaagagaatagccctgtccctcctgaacacggaggaattccccgttctcaggatctaatacgacgatatggttacaggtcccatcatctcttaatatatatttcatcgccgtatccgcatgatttttggcaatataggcaaatgccggggtctcagcctgttttgccgcccaaaataaaagcgggatattcataagggtgtcaacaatcatccaacctgtacaggcttccggcctgccgccgcggatatgagggttccatgcccttataaacctggcctccggattatatcttccggccaggagcgcagctgcatgaatccccctgacccgggagtgctcattaccggtaactttaaaatccgccactgcggtaggaagccacataaatcctacatcatggtgcagcccggcaaactgttcaaaagcggcatccagtcttttttccacattctccgccgaatttttaaagcagggatatccggtggcatgatacatctgccacatcatccctccccagaaaccattcacccagtccgtgatatcccttgtccctgaatcggtacggtatcttccgttttccggtacggatggaatcattgagcctgtccggctgcacactgcttccatttttttatacaacatagagcagctgtccttaacccatatgctgtcctcttttgataaatgatatttcatatttcctcccatctgttcattcattccggggattagtttttcttatcaagatattcctgaagctgtctcatgattgcttccctgataatttcaatgtcaggctccgccaaatcgtaaaattcgtttattttagcttctgtttcgctgccaaatgcgccggccataaagtgatggtaatagttttcctgaagcgccttatatgccgccagtgaggtggaaagctctgttgactcattggggttaaagataaatcctaaaatcggattgggctggaaattgtctttattccttgcccactgatcgtattttacgtattcacccagggagctgtttgtatggtaataaatgggagaccagcaaagctgatagcccgggaagttatatttattagcgggggagagtatggtaatagtcccgtcttcattcagctcgtaatcctcgccctcaattccataatggaataaatcattattttcctgagaagcaaaaatccagtcaaggaatttcatcgttctgtctatgttttccgagtagtagggcactaccatatagttatttgcaaaggactgattgctgaaagctttacccatgtcccgaacctgggactcatagaaatagcattccagttccgcctccggatttactgcctggagctgctgaagtgaattcacataaccggaaagatttccttctccaaccgcaaattttccgttattaaaccgtactcccaaatctgtggcagtcgtgaagtcttcattaatgtattttccccactcctgtcccagcctgactgcctcggcggttctgtaatttgtctgaaagcctaccggataagcagagaaccgatcatccggatcacctaatacgctcgcatccaggactgttttcccatcttcactgattaatgcctcaaactgctgtgtcgcacgtgcgcctgtggaatccacctcgcagatattattttccgcctttgtaaaagcgtcatacaggaaatagaagtaacctctgttccccaaaccggcagggctttcaatccccagttcatccttatgctccatcatggtatccatatacatccggaatgtctcttcatctttcacctcgggaagatcgtatttctttctccagtctccccttataaatatgcatctgcagtcattataggcttccaggagaggtattgcataaatctctccattttcataatacatagattccagcagatccccggaaaaagctttctgcagtcccggatactcgggattgttaaaataggatgaaagatcagcatacaggccatcctgaatgttcttggccatattcatccaataggcatcaaaagtaagatcacagggctcctgattcatcagcttcaggggcatttcctgtttatgatccgttgtccagttcagctttatggaggtattcagcgtgtctttagtcagatcctcaaaacggtcaaacaccttctgataattatctccctcattcataaaccaaaccgtaagctccacatgttccggggctccgcccacagccgctgcttcctcccctgacgcttccggggttacagcagcaccgctctctgccgccgggctctctcctgcctgtgttgactgcgtttcctttccgcagcccgtaatacccataagcatagccgctgacagcacaattgccgccgcttttttccactggaaatttcttttcttcatactacatttcctccttttttattctacatgcggttttcccgccctgtattcgattttcactttgtctagcccttaacggagccaaccataatcccaccggtaaaaaatctctgtgcaaacggataggctaaaacaatggggcctatcgtacagattgcagtcgccatcttcatcgtactcgaaggcatgttggcagagcttatattcattccctgtgcagccatatttgttattgtttccgccttccggattaactgcatgataagatactgcagcggccaggtttccttatccccgctgttatagagcatggctttaaaccattcattccagtagcccagtgcgtaaaaaagcccgacagtagccagcgccggtttagagcatggcaggataatccttaccaggatagtgaattcattcgcaccatcaatctttgccgattccgcaagagaagccggaatggaggcatagaaattgcgcagaagaaacatgttccacggaataaccagtaccgggagtatcagaacccatacggtattggtcagctttaagtatctggaaatcaaaatataagtgggtaccaatcctccgctgaaaagcattgtaaaatacacataaaagttaatagccggcccatacttcattcttttcgttgacaacggataggcaagcatggagctgaaaaacaggctcaggaaggtgcccgcaagcgcggtaaaaatcgataccttatagctgtcccatatctgccttccccccagcaccatttgatacgcctcaaatgaaatttttctcgggagcaaatggtagccttccctgatcaggcttgattcatcgctgaacgaagctgctataatatataggaacggaacaagacacaaaacagcaaatagcgtaacaatacaacagcttacaatacctactccgctcacctttcgttgcaatttagattgtttcattcatttttcctcctgaaaacagacttaaaatatggcggaatccggttccagcctgcgcgctatcccgttggcggctattacaagtgcaaagccgagtattgactgtatcatacctatcgcggtactcagcccgtattgccccaggttcctcatcgcccggtaaacataggtgtccaccacgtccgttgtgggatacagcatggaattgtcgcctaccagcgcataaatcatgccgaaatcaccataaaatatttttcccacgctgaataatgtcatcagcactatggtaggccttagtataggaagcgttatatatcggatccgatcccatcttgtcgccccgtcaatttccgccgcctccataatctgcggatctattccggttatggtagccagatatacgattgagccatagccggctccctgccacaccttcatacctatgagcaagggaggccatacccctgcctgtgaataaaaattcacctccagaccgattcctctcaggaatccggacagtaccccattgctggaattgagcataacattattcaggaaaagtgatacaattgtccatgatataaaatatggaagcaaagaacaggtctgcgtgattctggaatacttcttattccgcacttcactgaacgcaagagccagtatcacagaagcggctgtggtcgcaataataaataacgaattcagccacaaggtattgaccgcggcttttgataagcccggaaaaatactcctgttaaagaaaaatttaaaattatccagaccgcagaagggactcataaacccttcttttacattgaagttctgaaatgcgatgattaatcccgccataggcagataactgaaaatcaagaaaaacagtatccccggaactgtcattgcatatagaaaagcattttttctgatttcctgcaaaaagcctctgttatactgtcctccatccgtccctccataatttttacgacttacgctcttcactgttactccctcttttcttaaactcttaaattatgtgtaccggcaataccagccaaaaccacttagcactgcctcctgtcatttgtgattttaacaagctccccggctcatactcaagtatcagaaatcacagtggaaactttcaaacacgatgtgtgaattataacagtgtttgaaaatttaaacacaaggtccctgtttccttatccccctggtaaaagcaaacatatgcccggccggcgaagctgaaaaccgggcgatggaatacaatctccatcgcccggttctcattaacaactccggctttcctattattatttattatccagaaacgtctgaatctgcttcactaaatcacgacgtatgatttccagaccggcctcctccgccctggcatgatatcctttcaatgcctgttccacatcactatatgttccgtgaaaaagctggaaccatattttgcggtactcttcattgacagccgccagctccgtcctgacatctgagctgttatatacaaatcccgccaggggactgtccacatatgtgctgtccttttccatatatttctgatacgcaagcaatatttccggtgtatcgctgttgctcagctcgtaaccgacgttccagaccagttcataataaggaaaagtatatctgtttgcagcgctgcgcacggtataggagccctcgcctgtgatttcataatccctgccctctataccgtaacggaacaattcataattttctctgtccgcaaaaagccagtcaagaaacagcacagtgcgttccttttgctcttccgaagccgttattggtatccctacaaaattattggcaatacggttcgtataaacggctttctctttcatttctctttgttcggcatataagggcaggaaagccacttttccctccggatagttttcctgaagctcccgttcaatactgccgcggcttaacgtaccgatgcacaccgccgtatctccattaatgaaggtgtcctgcgaatcatatccgccgggagttgctaccgttatggaattttccacaagaaatttattccattccgtgaatttttcaaaccgttccatataataattgtactgatacccttccggatattctgcaaatgccgcatcctcatccccataggtagtcgcccccagacaggtctttccatcctttgaaattgccgcctcccagtacaattccatattccccgttccaaacggctcaaagatacctgccctgtttctttctacagactcatcattaaaaaactcataaaaacctttccgtcccaggtccatcggtatcatatccggatatttttcccgtaccgcatccagaaaccgttccagagaggccatatccgaaaccggtccaacgccgcatctctctctgagatcctccctgatataaagcatgaccatatccttttccacacccataatgggaatccaatataaatgcccgttgatacggttcgcttcgataacttcctcaggaaatgctttttttagtccgggatacttgtcattgttaaaatattcctgtaaatcataatacattccatttgaaacaagctcattatttgtcatccagggagcgtcatatgccaatgctacttttcttccggccattaactgcatctgtagtgtggacttatattctaccggagagatgaattcaaaattgaaggttacatttaatgtatcccttagtctttcctccgcttctgcaaccacatcatcaaagccttccggccttgtaccaaacaggcatatatggagagtcatttcctccatttgctccgttcctgctctatttgcgccataccataagaaaaggccggaaaacaaaaccagaacaacgggcataataatgaaagctttatttatttttctacctgctccaggctttttgatagcaatccctccctttgtctgtagctttcggcggtttcaccggtaattctcttaaataccacataaaaatatctgttatcggaataccccaccattcccgcaatcttctttccggtaaaatccgttgaacgcagcaggtttttagcttcttcaattctttttctctgtatataatcggataccgattccccgaattcatttttaaacagcaccctgacataattcgtagaaaatccaacttgagaagccgcctccgttaccgaaagcttttcttcctgaaaatgttcatcgatatactgccttaccttctgcgccagcctgcttttagccgcatcgctgtcctccacccgtcccgtcatatttgtaagaagctgtatcaacacgtttttcatttcttccttggtatcggcggcgttcattctgtttgtccagtttttccagtcaaggggacttccatcctttgtcgtgtaattataagttatcccaatatgaaataaagaaaatgtaagctgatttatggaccacttcatttccaccggagccattttctcaattgcatgaaaaaactcctccactccggacattatcacactttcctttgtccccttcaccccggccagaagctttttctccacttccaccggatatggaatacggctttcatagctttccatatgtgaggtaaataaaacaaccaaccgtgtgccccttataaaggtataagtcatcgcatatttcgtgtccagccatgatcggtttaattgctcatactgcctgatactgcgccccacgctgacggaaagtgtaatcggattaagcaccttctccagttcagccctggccgcttcgagtactttctggatccctgttatgttccggaaaggaatgtcatccagacagtaatcctcttccttttcatactctctgtcaagctgcagaatgagacaaacagactgatcaccatcctccattccatatgctctgtatcctctgctcccaaggtattcctccagaacatttataacggaaaagcaaaacaaccccaaatcattctgtgaataaacccttttcaatgaatcataatggttgaaactaaagcggacaacacagaaaaccggaccttccagcatcagccccacttccttcatttcttttatatctatctccggccagttgcctccatataataaccggctcataatttcatttcttttagcctggttatacctgtgtttctttacctccatttcattcgtattggccgacagcttttttaccgctgaattcagcaattcatattcatcctgatatccgtcattttccagcccgtttaaatccatattgctcaaaagttctttcatgggtatataaatccttctggtaaaccggatggaaaataacaagcctatcatgataaagcaaaacgaactgaaaataatcacactgttatatttattaaattcggaaaacagttcattataatccgcaattcccacataggtccatccaaacacacttgaattctgccaggagatgtaacagtttttatcatcggcccggaaatcaaaagaatccttctcttttcctgaattcactattctgtaaacatacccgtccgtcagcctttcgccaattccggcggcattcccagataccagatgcccctgcgcatcgatcacttccgttatcacataggatttctccagatttttaccgataaagttctgatatttttcctgatccacattaactatcagagccattctttttccgtccgccagactctcatcataaaacacataagaaattacattgctggttttccgggccgagcctatcttccaatgcatttccctgggatacagcttatttttaccctgattcttcacaatgcactctatcatttcctgatcataaaactgctttatgggaaaagcgccctcgttactggaaaaaataattcccagctgctcattatacagacagacggaatgggtaatcatatctctgcccgcacagtccagcagataatcaatgacttccgtatactcattcggctccattgtttccgcatttaaatatcttcgcatctgcggagcataatacagattaaaaaaataggaaaaattttgttccaacagaatatcagacgtattatacgcctgctccagggtccgatacaccgaatcctgtatttcttttttcatctgccgtacaacaagcatttctgtcagtgcgaaaaaaaacaccagcacaagtattgtataagcagcgtaggggagcagaacccggtacagaattccatgagagtggagtatcttattcactttattattattttctattttatgcataatatcatcataaaataaaaaggaaacggttgcaacaacttccctgcttttattcaccccatttaccgccctgcggatatactctacccgtctggtatcgtcatccgtgctaactccattctcagtaataagaataggaatcggcagctgtgtggctacatgccgtaccacatttccgattgactccgggtaaaatccatcatccgcccatattttagccaaccgttcttctccgccctgccgcgcctggagatcatacaacgaaagggtgagtctaactttgaaatgcgggcatatttctttcattgcctcacgaactgcctcgtcattttttcccgcataacttctggcagttcaaatgtcatcccaacctgaggcattatccccattttcgtcatcatatcgcgtgccacatctgctgtctgccaaaagtctgccaccagacgaatactgctgttcttgaaatattcgtatttttctttatttcaccacccttaatcctctttcaccagcgtgttccatcaaagttcggattactttatttgggagtccggcgaaagttcaaaattgtgcggagatcttcttccggtgtagtaataggagcaatgttataatgctctgccaaaaatttcagtacattaggtgagataaaagcaggcagcgtgggaccgagtttaatgttctgaatgccaagatacaacagggtcagcaagatgcagaccgccttctgttcataccatgataaaatcatggaaagcggtaactcattgacgccacagttaaaggcttctgacaatgctatcgccaccttgatggcactgtacgcatcgttacactgccccatatccatcagcctgggcagccctccgacggttccgagatcaagatcgttgaaacggtatttgccacaagcgagagtaagtaccacagtgtcgttggcggtctgtttcacaaactctgtataataattacgtcccggttttgcaccgtcgcagccaccgaccaggaagaaatgtttaattgcaccggtttttaccgcattgattatcttatctgcaacgtcgaggacagcgccatggccaaaacccgttttaaccaccttcccgccattgattcctgtaaattctgtatcctgtacaaaaccgcccagtgtcagagccttttcgattaccggggtaaagtccttatctttaccaatatgaaccatttccggataggatacgacttcagtagtaaaaacccgatcggcatagctttctttcaccggcatcaggcagttcgttgtatagagaatgggtgcagggagagatgcaaactctttctgctggttctgccatgctgtgccgaaatttccctttaagtgcggatacttttttaattccggataagcatgcgccggcagcatttctccgtgggtgtagatattcacaccttttccctctgtctgttcaagtaacagcttcagatcccagagatcatgacctgtgatgacgatgaacggccctttctcgatgcataaaggtacttctgcaggtacaggcgtaccaaaggtttctgtatttgcccgatccagcagttccatacaagtgaggttcaccttgcccagttccatcacaattggcagcaattcctccatgctccagtcctcggccagaacaaacagtgacttatagaaaaaagcagtcacttcatcattgccataaccaagcacagccgcatgataagcataggccgccatgccgcgaataccgaaaagaataagtgactttaatgaacggatatcttcatttgcattccaaagttcttccatgttgtagtcatctgtattcccacatcgggaagtacagccggaacaattcgggacaatgttgtttttctcagaacgtacgcggtcaatcagttcctccaaagtctgatcattaaagcttacattagtgactgtagtaaacagtccctccaaaatcagacgatctgtatgttccgttttaggattgttggagcaggcgcgagccaggccaatcaatgcgccggttaactcatcctgtaattttgcagtattggcagtctttccgcacacccctgcatttcctgtacatccgatgcagccggcagtttgttcacactgatagcaaaacattttcttatccattttcatatactcctcgcttttcaaacggtctcctcatgggaaaccacccaattcgttacagtaatcatctcttgttcaattttataatttttcgaaccatattttgtacctcctgaaaacattgtcatctttactttgtgaatctaatatactataactattctgacgtgtatgttgttttaacaacaaaaaggaaacttgatgccctgaaactgtgttcccgggatctttgctctgagatccccgattatcacgaaagctggcccagtgatataaatttcagtggcaagctttggctgtcagatagtgaattttcaaaaaggaatagggcttaaccatacagggattggcagtaggttgtaaaaggaaaggggttttgtttggtttatagcgtattacgatttattcttttccctaacttttttctgtattgtaatatttttctttagtcagaaattatttcatcccattccgccatcagttcttccagctgcccgtttgcggcacggagcagttcttccagttccatcaatttttcataatctgcctgaaccgcaggttccaccagctgtgcctgatatgcttctatctgctcttctttctccgcaatcagcatttccagacgttcctgtcgccgtttcttctttgccgcttcttttcccggattatagcccttggggctgctctgatccacttccggctgtcggccatgtgccggcggttcagccggcaatgtttccttccgggacatattgaaagattttccaggacgctgcgtttttccgtcttccaacggctgctgttcctgctgctcggcctgaactttttcccaatactgctcataaccatagggataaaaattcaccgcgccgtcctcaaataccagcagggaatccgcaatttcttttacaaaatacctgtcatgggatacaaaaagcacacttccgggatattccttcagcatggactccagggattccttgcctacaatgtccatgtggttggtaggctcatccaaaatcagcaggttaggcagcctgcggaagattttagccagcgccagccgcaccttctccccgcccgacagcatattgattttcttaaacacttcctcctgcccgaacaaaaaagctcccagccaggaacgcacatccaggcgcttcagatccggaaactcctcccagaaatcatcaagaactgttttatcactggtgtactgcgccatctgctgttcaaaatatccccaatccactctgtccccaaaggcaaaactgccgcccaaaggctccagctgaccggtcagcgtacgcagcagcgttgactttccggcaccattgtcaccgattatgcctattttctgccccttcttctgttcaaatgtcactgtcgccaggggtttctcatagccaattgacagccgggatacccgcagtacatccgtaacactttctctgtccggcttaaaatcagcatggaaggttttcaaatcatatttgactggcgcatcgatcttaaccatgtgttctatctgtttgagctttgaccgggtcattgccactttagtaggtttgtttttaaatcgttccaccagtgtctgcagccgttcgatttctttttgctgcagttcgtaatcttttctctgcttttcccagttcagccgtttgcgttccacaaatgcggaataattcccgggataccgcaccgctgttttatactctatttcatataccacatccactacacgatccagaaacattcggtcatgggatacgatgactacggccctgtcataatcctttaaatacccttccagccagttaatggtcgccatatccagatgattggtaggctcgtccagaagaaggatatccggtttacttaaaagcattcttgcaaaggctattttcgtctgctgtcctccggagaattcggttaacttcttctttttatcctcctgaccaaagcccagctttttcagaacgatttcatattctttttcaaaggtatagccgcccaggtaagcgaattgttcttccagcctcacatagcgggaaatcaccgcttctccgtcttccccttccatgacagccaccaggcgttccatctcttccttcatttgaagaatatcggaaaaagctttccgcacttcctcttccatggtcagtgtatcatcttcaaatgcgttctgttttaaatacccgatcaccggctttcctgctttggcgatatagatatcttcatcgctgtcccttttggacagttccacctctcccgcaataagcttcaataaagtggtcttcccgcatccgttccgtcccactaccgcaattttctctgttttgcggatttcaaaatttatatgctccagcactgtttccgctgcgaattttaccgctccgttgcaaatctgatataacatgataaatgtcctctcttttccccttatcccggattttccataaaaaaacactgtttgtttccaaacagtgcaaaaaaccggtacacatgcacagcatccgccatgcattcatatggaagtgtattcttccccctgcatgatggtctgtgtcaaatgctgatccctgctgcctgtttgtaaatacaacaaaaataaatccgtattgtatgcgggccttctccgcatcctacgaatctccttaacaaaaaaccgtcgcttttataacaatacggttctttgtcagtctttcagttgtggtttactaccagcagcgcttcatgggtctcctccggacaatcatctttttttaacaggcggtaaacctaccgccgtattaatttttactatagcatgggaatgatgcagcgtcaacgggatttttagcttttcgatggcctgcaattgtagtttttcatataaaaatgaactacacactcatcttcaattataatttctttgcattatatcatatcacatcaatattccaactctattcgttaggatattttttgttttaatccaatcttaatagtgtcaataaaattacgaaattatatatttattcttttaacacttcctccttctataacaggttttattttaattttactatgcataggtacctttttctcctctattatatctaacaaaatctgtgcacatttctttccctgttcataagccgataaaggtatagtagttaggtgaggataaatatacctgccaatttccaatcctcctagactaattacagaaatatcttccggcaccgacactttttcttcctgaaaatgtatcatgaacgcgaaggacaagaattatatacccctcctatccccattgccccaaacgcatttccgtgctataattaataaatttttaaaccagtaaaccgaacaccaagtaggaggatttcaattattatgaaacgtattatgctgcagacatacgtcagcgatgccacggcggcaatcgagctgtacaaaagggcttttggtgcgaaagtgctggaaatccatcatactccggaggggaaggtatttcactctgaactgagtatagacggctgtattttagctgttgcagacagagaagacggagatgggacaagcgatattacaggcaatatcatgcagttctgcctgcattttgaaccaggtaaagaagatatagtagtgaaagcatatgaagtattatccgataagggaagtgtccatgttcccttaggtccaagcgttttcagttcctgtatgacggatctcaccgactgttacggcattcggtggtgcatcttcacggcatagccagatccgttttccaggcataagattaccggccggtatcccctgtcacagtgacagagaataccggccggtaatcttctctttattcaaatatcttcattcccttatcaattctgaaagcatgttaccgggaaccctcgtcatgcagcaattcccgaagcagtcggtaaaggtagttgacatccagcggctttgggataaactcgtccatacccgccgccatcgcttcgtccacatcctctgtgaaagtatttgcggtcatagccacaatgggaatgccggccgcgtccgggcgatccaatgaccggatggcgcgggccgcctccagtccattcatttcaggcatctggatatccatgaggatcacccggaattcgcctggcctgctttcggagaacatctctaccgcctgtctgccattcacgctgcggcttacctttgcgccctgaatctccaaaagctgcgccgcgatctcggcattaaggtcgttatcctccgccataagaataggaacaccctccagcgacttgtccttcggctgcacgctctgtccgcatgcaaaggtttccgctgaatttttcaggggcagtgtaacggtaaagaagaattcactcccttctcccggctggctgctgaccttcagttcgcctcccattttcaggacaatatttctgctgatggcaagtcccagtcctgtcccctggctctttgaatagctggtacccacctgctcaaagctatcgaaaatacgcttctggtcctccggggtgatgcctgtcccggtatcgatcacccggaaggtaaaggccgcctcttcctctgtcccctcctcctccgttacccgcaggtatacgttcccccctgccggggtaaatttgaaggcgttggaaagcaggttgacaagtacctgccgcaaacgaatgccgtcgccgataagactgctgtgtacaattctcttttccagcgtgaaaaccaggccctttcgctgtgcctcagactccatcatcatccggatcccgtccaggatattatccagagaaaaggggtcgtttgcaagggtcagttttccgctgtcgatacggctcatgtccagtatgtcgttaatcagatccagcatgtaatgggaggccgtgcggagcttcgacagattcttctgaacctcgggcggcacgccctccatcatgccggtgaggtctgtaagaccgattacggcattcatgggcgtacgcagctcatggctcatgcgggaaaggaattctcccttggcgcggctctccgcctcagccttctccagattgctcttcatgagggccgccctcatccgcgcccgatagataccaaacaaaaacaccgacagtaccgacaggaacagtgtcagtacagcgacaaaggccacaggataggcataaatgagttccataagtgtaagctcgttcgtcccgatagagattaggttccgatccagaatcgtggaacgctcccttgaggaaaggctgttgatggccttgttgagaatggtcagcaggtcgggatccgaaggcctttccagtgcaaatgcgagatcgcttcgatcattgaccagggccaccggcaccagattagagaaatgatagcgctgaatatccagttcaaaccggctggcaagaccataaataaagtctgcctcgcctttgtttaccgcccggagcgcctctgtaacagtgggatatttccgcacttcagccgcttcaatcccggcgggcagctcctgcccattgacgacggcacagaccagcccatcgtccggatacgaggatgtcttgttacggaccacgatattgttcatattcacatagggcgaagtgagcgtaagtccctgccggacggactcctcttcggttcccatgtaaaagcagagcagatccgcctccccctgccggaccatattcagcgcatcgccgtaggtatcggtataaacatacgtaaaagtaagccctgtaaactccgacattttgtcaagggtatcaggcacgatccccctgtgaagattatctgctgaattgaggcagaccagaggatgatagttttcaggtaccgccacggtgacagcgtcccggttccggacataatttagctccgcctcactgagttgtatgtctattgaaccctcattccggaagttagcctcatactgctctgcgccgaagctcggattggaatccgctattttttccatagccatattcaatccatccagaatctcctggtttcccacgttggtcactatataataaggctgcgactcaaaggatgcgacgatacggaaattcatgggatcctcgaacccgtttccaagcagcaggtctacctcgccgttctccaggtaggggtaaagtttcccgttttccgcgagctgctcatagctgtaggtacggatttcgcagtccaaatcgtgcatggacaggtattccttaagcctgcgggtgttttcctgggcccgctcataaacgccgatggttttgccgttcaggctccgcagatcatagctgttgatactgctgtcgtctttccgggccatgagcaccgctttgctgtacccgatgttataatcgggataggcaaaaaactcctcaaagcctggggaatagtagtttcctcccatcaggtcatacttgccctccaggaactcctcaaccatgctgtcactatctgtgtctatatactcatgttcccagccggtatatttggcaatctcattcaggtagtccaccaccagcccctggcggcggccatctgatgttgtttccgtcattcccgccacctgtggaaaaggaactctgagcacccgcggctcctgttcagcagcctgcacattctgaatggatgcagccgcccaaaatcccagcaggaatataagatttacccccctaatccagttttcaatccatcttttcaatatgtatccacactccctttatgtatttctgatatctctccttttctattatcctatttgtggatacaatccgcaagagttttacaaagctgtgtgatatccagcggtttgctgacatgggtattcatcccggcagccagagcggcggagatatcgtcattaaaagcattggctgttgcagcaatgataggaattatacgggccagcggatgatctgatgcgcgtatccgtctcgtggcctcatgtccgtccataaccggcatctgtacatccatcaggatagcatcgtattcaccgggccttgaagcgaggaaggcatccagcgcctgccggccatcctccacacagtctaccacagcgccttccattcgcagaagcgttgcggcgatctcctggttgagggcattgtcctccgccaccagcagatgaaacccttccagaagtttaccggccgttttttcttcttctcctgcaaacggctgtcccttgtgatccagcgcagacttgatggccgcatcgttttcttccataagcatctcaaactcttttacctgaaccggctttgaaaaataatacccctgcacgcattcacagccgatctcacgcagacgttccagctgttccccggtttcaacgccttccgccaccacactcagcgacatcaggtgcgcaaggttgatgatgaagcgcatgatttcctggttgaccggggtcaccggctcgctctggatgaacttcatgtccagctttaaaacatctacgggcatctcatggagcatatgtaaagacgaatatccgcttccgaaatcatccatctccaccacaaatcccagttcccgcaaatgactgacggtctcaataatctgcctcgggttttccgtataggcgctttcggtgatttccaaatggagactggcaggagaaaggctatatttctgcagaagtcccattaagacagcagtcaaatccgcattataaatatccgcccgggatacatttacggaaaccggcagctgcggcagtccccttttcttccagctctgcataacggcgcagaccttatcccagacatactgatccagccgggtgataaacccgttgcgctcaaacagcggaataaacactgcgggagactgcagtccccattccggatggttccagcggatcagcgcttcggcgccggacatacggtcatccttaaggcggtacttcggctgaaggtagatttcaaattggccctgtgccagagcggcctccatgctgtcaacgatttcctgctcctgcagcagtttgctgcggagctcatcatcatagtaggcaaaatatttattatatctttctttgatgctccgaactgccagctgcgcccggtcacacatctgctctacggaaacatttctgtcctcaacacggtagattccccacttcatcacgatattctgtgtctgggacagcaggttaatccggctgcaggaatcctgaaacatcttttctgtgtattcccagttacgttcaatgatgcaggcaaactgatccgcatgaaaatggctgcagattcctcttccggccgtcagaccggtatgtacctgcgcaaccatcctgaggagccggtctcctgcgggaatgccgaaaatatcattgaccagcttaaaattgacaatatcagagcagatgatatcatactccttatccagattctggtgcagaagctcccctgcctgctgacagaagaattccttgctgtaaaggccggtcagccgatcataccggaattcattgacgagggctgcggattcccgcagatgaatgatattggcagcacggtgcagaatgatctgcggtttgtaaggcttgaccacaaaatcggctgcgccgcaggaaagggctgtcacctcttccgattctgcgtcattttgtgtggtgacaatcaccgggatggcggaaaaatcaggggcatccttgaccgcggacaaaaactcatagccatccataacaggcatgactatatccagcaggattagggaaaaatttccatcctcctcccgtaaacgagcaagagcctcccggccgttttccgcctccgcaacatcatactcggtttttaatatttcgcataaaatccccctgttaagggggttgtcttccactaccagaatttttctttttgccgtcaccgccactgcatccacctttttatcccgaccggcacttcgatgcggcttccttacaccaagtaaccacaattcctgccatgctcagtaccgtaatatgtattttaccgatcttttattcctggctgcctttcttttcctgcagccgcttgtattccgtaatatccgcacagttgatcagataggcgctgtcatccccccatttcattggggaaaactgaaattttacccagatgccatacagtgggttgtaaacctccgcggctccggtcagcgggcagttctcacagggagcgctgcggccgaaaaacgcctggtgacaggccatgccggccctggctgccggatccagccggagcagcttttgattcatatacagcagctcgtaggtatcctgccgaatcgcgtaaatataggcatcctgcatatccagaatggtattcagctgaaccatgatctgtttattgcggtcagtctcccgttttctcaacaggaatgtggtcagcatctgggcgaccagagagaggatgccaatctcctccttattccacatccgcagccccgtacactcgtcgaagccgatgaagccgcagaattccttttcatcatacagcgcgcactgaagggttgaacaaataccctggctttcaaaaagcctgctctgggcgggcgtgagggaatggatatccctgcagtaaaaaacagaatgatcccggaaaagttccctgtagccttccaccttctcatagggatattgctgcagaaactccttttggggcataatcccctcattacaccattcataggtgttatccgtatagctgccgcagaaactgttttcgaacacataggcgcggctcacatcgaagcgcctgcccacgatttccagaattgttttgatggcgtcatcgatatcattcgtatcatatagaatttgaaatacataattgaccaaatcaccggtctttccgccagtagtctgatccgaatcgatggacgctcccaaagaggaatagccaatccgctccatcgccgccatgctttcggcatcaaaccgtgcataccggttcttcccccagcatttggcctgatacagcgccagatctgcgcagtggtacagttcctgataactgctgccgtcccacggataaaccgcgagaccgatactgcaggtcacctcaacagactgcttttctccctgaaacagatcctgaaacagctgtaacagcttccgggctttatcctcggcgatgcttaccgacggaagatccttgagaaacatggcgaactcatccccgccaatcctgccgatcacatccgatttccgcgttattttcttcatgcctgccgccagctcggccagcaccgcatccccgaacaggtgcccctgaccgtcattcaccagcttgaaattatccacatctatgatgaacatcgcacagattgtatccggcttatcagccagatacagctccgatctccgctctgtttcggtatggttataaaggcctgtcaatgcatccagctccgccctcctgcgcagttcttccaccatccgtttttcttcatcaatatctgaaatcgtccccaccgcccggagcggtgtattttccgcactgtattgggtcgcagcccgtatccggcaccaaatatactgatcctttaagctgcggatccggacatcaattaccgaatcagatatgccccttttggcttcttccataaatgcggccatcggctccacatcatcgggataaaaattatgcagcatttcttccttctgcagcctgccgtcataatgcggggcatagccgaacttttccagccagttaggggaaaaagatatggaatccgctatgagatcccattcaaaaataatgtcggaggattggttcataataatttccagatgttccaatgacagacgcagcttctcctgtgcgtcccggacctcggtaagatcaagaaaaatacagaaaaaacgttcttccttctcatccccaaacaattgctcgctgctggcaatccatttatagtttccgtctttgcacaaaacccgatagcttagggaaagccgatcgcttttttccagctgccgttccacttcaataagaaaattctgctgatccgacgggtgaatcatatggaaaaaccggttctggaactgttcgtcaagctcttccctggtaaacccaaacatgctaagaaaaccatcgttgacctcaacgatggtatagctactgtcattcctgcactgcataaccccgccggggataagatttaagagggcctctccttccgggcagagccctttcagcagtcttttcatgtaaatctcctctcaatcccgaatccgattgtgctcctatggcttaccttcattacttgtctgtcatcaccgtatccgtcaccgtcggaaatcgtttattgctcatatgcatatatattttactatagcaaaagccattacaaatagcaatagatatccgtttttcaatgaaagaatgaaaaatgaaaaaacggcagacaaatttccggatcctgtccacaaatacgctgccgcttattactaatcaaatcaattttcttcagctgtaaccggaatccggatctggattctcgtgtcctctcctgcattgctgtaaatttcaatcccataatcatcgccatagaaaatacggatcctgtcatttacatttttcagcccgtaccccttcgattcctgatttatggcccgtttttcttcatcccctgcaaaccccggcccgttgtccgtaaccgccaataccagttcatccccctctttccgggctaaaatacggagtatgccgcggccatcccgctttttatctattccgtgctccagtgcattctcaatcagcggctgcaggatattgcatattacctggcacggcctgcagtcctccccgatttcgtactccacatcaaagctgttattatgcagggccagctggatactgatatagctctgggcgtttaaaagctcttcctctgccgtagtggtcgcctttccgctatttaaggctgtcctgtaaaaggaggatatatccctgctgattttggcaatctctttttcccccgctctgagcgcgctccagttaataaaggaaagagtattgtacagaaaatgtggattcagctgggcctgcagcatcttgaactccgcctctttctgaatgatctggctccggtatacctcattcaccaatacgttcagcttcttaatcatggccccaaaagcgttcgtaagctgccctatttcatcctccgcctcggaagaaacctcaatggaaaaatccccttcctccacctgcctgatatgcttgcgcagcttctccatcggacctaacagccagcggcagagcagccagctcatcagcagacatagaaaaatggcaaggatcagtacaaggaaggtcgcctttaatatggacggatcattgatttccatatttttttcaggaacaaaacagagcgatttccatcctgtttccagtatattattcacaaacagaatatatttttctccgtccagcctgacttcctgataattctcggcgtttgcatactccgtatactcctgtataccgagactttcgaatataatattttcactgccgtcaatcaataataattttttctctccgttcagcatgagtccgagagattccgaaatacggaactcgatatacagaacatttgtcaaatccgccccctggaaaggatattgacatagtgccgtaagctttccgtcattgattttgtaattaagcagcatcctgccggaggctttatcataatccggtaattcctccagatcataaagatatctggaatgccctttcaaagtttcattatccgtatatattttcacaaaaagtatattggaatgggagcttacgatactttctatcgtaggctccaggctgttttgaaacatcagatactgctgaaagtagctgatattttccgtgttcaggcattggatgatttccgaattgtacaacaggctggatatcaccgtctggctttgggcgatctggctgttcagcatggtattggcctgccatatctgttccttcacactctgtttctgcttatccagtaaattattgtgggcctggtaataagaataaattcccagaggaatcaatgtgatgctggatgtaatgaagaaagcggcaaacagcttccgggaaaatttagtattctgaatttttcttttcagtccgctccataccttcatatccttttatcctccctgccgcagcccgttattcttacaatcttactttctctatttatcttccgtgttccctgaattgagccggcgacaccccgacgttatttttaaaggttatattaaaataagaataattctgatatcccacttttgcagcgatatcagaaattttcatgttcccggaaagaagcagttcctttgctttgtccagcctggtcatagttatatacttaatcagactgaccccgacctcttttttaaaaagataactcaaataagaaggggataaatatacctcctccgcaatggactgtaagctgatatcctcctgataatactgttccacaatttcaatgacagaacgtatcacctttttatgttcggaacctcctgattcctccgccgtattcatttccataaattgtgcggaaagagccagcatcattttatgaattccggacagcgaattttcctcaaacagactgtccagagacattttaaaatccccataagctatactgctgttatcaaataatctttttaaaatattagaatacagatacttgacataaatctgggaatccataatatgagaacggagctcttcccgaagcagggtcaggttttccgttacatagggaagattcttattatccaccccatgatagatttcctttacaatcctctctataatctgctcggaactgcccgatcccgtattgctttcattgacatagagcagctgattgccatccatgaaaaaatgaaaacgaagcatctcctccatccgcagaaaacagtcctgaagttcttcacagccggaaacttcccttcccatcacgacacatgcctgccggataccgcattgctccagaaatcccataacagacggaccgctctcatcccctttatgcagaaacaaaagaaataacccctcacttacggcaatacagctttgcataagaacaaacgcatcctttatgccttcataaaaggaagcgatggctgtttcattttcatcctgcatatcataaagctgcagccggaaggcttcgctgccgtcaagcagttcctccagccataacggcggaggcccttctttatgcagaaaggctcccatcacatccacaacgcccacaccaggacgctgcaggcgcctgctttcttcctgttcccttgtaaccgtctccacgatttcggaaaggatattctgaaattcatccggatctatcggcttcagaaaataatgcagaacccggttttccaaagcggtcttggcatagctgaaatctgcgaaagcgctgaagatcacaattttcaggcctttaaatttctgattcgcctgtaccagcagttccagcccatccataaagggcattttaatatcggtaaaaaggatatcaaccgcatgcgtttccaggcacttcatggcctcttccccattttccgccatatacacctggaattcatagggactctgctccagaagcaggccaatcccttctctttcaatccattcatcatcagcaattaataccgataacatgtttccctccctcatctctccggttttcggcattttattccttaacggaaccgagcgttattcctgttacaaaatatttttgaagaaacggatataccactaatataggaagcagggcaatcataattttggccgcattcagggtcttgttggaagactgcatgatattttccagctgcctcggatccgtaatattggtggtgtccgtaggaatcaccagctgctgtatataagtcatcatcggaaccttggagggcgtattgatatatatcattccgtcaaaaaaggaattccactggttaacaatactgaaaagcgtgattgtagccaggcagggaagggaaatcggaagaaatatcttaaacaggatatccacatgggacgccccgtccatgatagccgcttcttccatacccggactgatattgcggaaatagttcatgagcaggataacattataaatcggtacggctccgggcagtaccagtgaccagaaggaattgatcagtcccagacggctgaccgtcagatacagcggaatcagtccggctgaaaacatcatgcagaaaatcaaaatccacatatatacattgcgtccccggaacagcttcggagattttgacagaggatacgccatcaaaaccgtcagtataaggttcaggccgcctccgacaatgacacgcaggacggacactccgaaggcagtaaaaaatccgctgtccttcagcagcatcttataggatgcaaggttaaatcccttgggaagaagaaaaacctcccctgccgccgccctggatttattgctgaaggaaagagacagcgtattcaaaaaaggaatcaggcaggtaaggctgacagccacaacaattatgacaatcagataatgtcccagtttttctccgggtctttcttttattttcatagtttgcatcacctttctcactctgtcagaaaatccggtagttggcaaatttctccgccagcttataggaaataattatcagcaggaagcttatgacggatttcatcatacccacggcggtcgcaaggctgaactgggcattctgcagtcccatacgatatacataggtatctataatatccccggtccggtatacaagcgggttataaaggttgaatacctgatcaaagcctgcattcagaacattgcccagactcagcgtccccaccagcactatcgtgctcacaatggagggcagtgttatatagatcagctgtttggatctggtcgccccgtcaatggcgcttgcctcataaagagtgggatcaatccctgccagcgcggcaagaaaaataatactgttatatccaaagcccttccatacatcggaaagtatcactatcgggcggaaccatgtattgctgcccatgaaaataatgggctctatccccactcccgaaagaagggtattaataattcctgatttggaaaagatatccgcaataatgcttcccaggattacccaggatataaaattaggcagataaacaattgtctgaagtgtcctttttaacagtttacatcggattgcattaagcatcaatgcgaaaaccagagggaccagcagatttaatatcattttggaaacagcaataaccaaagtatttacaaatatctgcctgctgtcgggcagctggaacataaatttaaaattatccagccccacccactttgatcctaaaaggccttttgccggaaggaaattctggaaggccataataaaccccgcaagcggtataatgttgaataacaatataaaaatcatgcccggagctatcatagcatgaaaagtaatattagcttttctgtttttcacgttgcctcctccttacaacagccggatgtctgctttctgcaggcatccggctgccgtcagcttttcattatcagccctgattctttattatttcagtcgcttcctgcataatctgatccccgcccagtgatttccactgagatacgaattcgtcaaaataatccaggtctttttctccggttatgatagcaagcagcgcttcattttccagcttttccaaagatgtccatcttgccgtcatagaatccgtcatggcaaagaaaacacaattatccgccacctttacattttccatgctggccacttcatatccgcctgtacgggccatatagcctgaccactgatccctgtttgcttccggatcctctttatacttaagccttgcctcataaaccggcaccatgacatcactgagaatactgggatccttagtttcttccgcttcattcagcgccgcatattctttgggcatgtaatcctgctcggagaactgcagattaagagggatgattgtcttcccgtctgcaggagtccctctgtagggataagcatacccctccggcaaatccttcaccggctgcagccactcgctcagctggctctgaagcttcataatggcttccggatgagggaaatcctttcttaccaccgcccagtatgtatggatttcctgctgatatgttttaaatttcccgtctttatccaaaggacataaatagggctgccagtcggcatccggatcattatttacactatcctgcaaggtatacggcgcccaccagggcccgaaaataataccgcattttcctgctgccagaggagagttgatgtcattagggttcctcaccgcaaattcctcgtcaatcagcttatccgcatacatctggcggagtgtggcaagcgcttcctttgtttccggagcgatagttccatatgtcacattgccgctttcatctttgagccactgacggggataggagccgtaataaccgaaaatgggatccatggtatgattggaattatagatgcctcccaccctctggtcacagagaaggccgatggtatcattctgtccgtttccgtccggatcctcctccacaaaagcctttgctaccgcctgaagctcttccagcgaaccgggctccttcagtcccagcttatcaagccagtccttcctgatccaggtaaaggcataggaatagccgggtacatagttggaaatagccttcagctttccgtcaaacgtacaggtatcgaatttccggtctccataagtatccagcacagccttattgtaagagctcatgccgatttcgtaagcggagtccaaatcggctaccagatccgattccacaagctgtgaaagaaggacctgattgggtaccatcatgatatcgggcatctggcctgaggtgatagccaggctgaccttctgggaaagcgccgcctcatccactgccatccattcaaccttcacatccatattccagcgttccttataaaggcgggtgaattcattatcctccagagtatcaccctccggaaggttcatatcctgcggattccccagacctccaatggtgaccgtcagcgtttcctcataaggatcatcccagcctgccggaaccggaattccgtcggaaggcatactttccgcaccggcactgccggaattgctttcgctctgtgttcctaccggctgagtaccgccggtctgtgcatcctgtccgcatcccaccatggaaaccaccatggataaggtgagcagtatcgccgctattttctttttcattgcatatcctcctactttttctgttgagctcccgggcagctcctgtatctttatactaatggctcaaagtacttccaacaagattaggttttttcgatttctttttattttttatgattttatttctttgggctgttttctttaaggataatttcagccacggaacatgccggaaggataaagcttatcccgccgtcctttcttttgatttcctgcaattcattcagctttatattttccggattatcaaaggtattatgagcggccatgtctccctgaaggattcttccttccataatctccggggtatagcccagaagataacagtctatttcttccgaccggaaaggagacagattgctgacagtcagatgtaactctccgtcctttatggacgccgtgtgggataaggaagggatacggctctcctcatccccgatttcttctgtctccagccagcttccaagcagagaggcatcctgatggcctttatacagctcaaaaacatagtaggtgggcgtaagtatcatatgccggccttccgtaaggataatcgaatgaattacattgaccatctgcgccagattagccatttttacacgatctgaatgcttgttgaaaatatccagctgcaccgctgccagcagggcatccctgaccgttccctgctgatagagaaaagccggatgcgtcccctcctccacttcataccaggctccccattcatccaccaccagccctacttcatgggcaggatcatatctgctcatgatttcacaatgcttttcgatcagttcatccatacgcagggcacgtacaaacccccggtaataatccggcagttcaaactccgttgctctttttttatgctcccaggtattgggctgtgtataatagtgaagagaaataccgtccataagacgccggtttcctgtataagctgcggtcttcattacaccttccgtccattgatagtcggcaacatccgctcctccggctatacaatacagccggttatccccataattcctgcagaaggtacggtaacggcggaattcctgtccatactgctccggcgtcatattgcctccgcatccccagttttcatttcccacaccccagtattttacatgccatgcctcaggatgtccgttttcagccctcagttctgacatgggcgagcttccgtcaaaggtcaggtattctatccagtcactcatttcctccacggtgcctgaacctacatttccgcatatataaggttcgcagcctatctgctcacacagctccatgaactcatgcgtcccgaaggaattgtcctccaccacatcaccccagtttgcgttgacgatttttttacgcttttccctggggccgatgccgtccttccaatgatagtagtccgcaaagcagcctcccggccaccgcagtaccggcagctgtatctgctgcagggcttccaccacatcacaccgcatgccctttacgttcctgatgtcagaggcctctcccacataaattccttcatagattcctctgcccagatgctcggaaaactgtccgtacagttccctgctgattttgctttttctgtcccacgcattgatgacaagctttgccatattctttcctcctcactttggtaaacggtattttattgtgcaatcatatgataagaggatatggggctggttatcaatttcaaataattacgttttgattatattttttatggaaatctgttccggaagctccgacgtcttccgccttctgatatcgcaatagtacattcaattatccaaataagtgtgattgcgccaatggatcaaaaaaaagcatctcttgcggagatgccttttttcggcagtcatacatttgataaatccttcttcaccgtcctgcggtattcaacaggcgtcactccgaatctttctttaaacagcctggaaaaatactggcttttccgatatccgatgagttccataacctcatggacctttaattcggtctgctccagaagttcagcagctttctgcatcctgatatccgtaatataagcggataaattcatatttgttacttccttgaatatcttggacagataagccggatggagatggacgacttctcccaatacatccagagaaagattctgatcaaaattttcatatatataattcttcacgtaggaaatcagtgcgtttttatcgccggccaggcagattttgtcctcctcttttttctcttccaacacaaaattcttctgcaggatacgttccagcgtttccaccaggtcgccctttaggacaggttttaccagatattccgacaccccataatgcagcgcctgcctggcatacccgaaatcactgtagccggatataataattacttttgtcgggtattttttctcatcaatgaatgcggacaaatcaagccctgatatccgaggcattttaatatcggttatcagaagctccggtacgaaatcctgaaggatatccctggccatggagcctccgtttgcgacgaaaacctgatcaaatccataatccctccaatccaccagtttttgtatatattcggccatatataattcatcatcagcaatcaacagcttcattttccgtcctcttcggtaaaatagtaaaggaaaccagtaagcctccccaaatactcctgccgaaccgcagtcccgcagaactatcataataattaatcagcctttggtttacattccacaaccctacgctttcttcctcatcccgcttctttttatgcaggttttccagcagcagctcaatctccttttcagacattccatcgccgtcatctgaaatctcaaaccgcacggaaccgtccggcagtttatagattttaacaaataaatacttggcattttctctttcttcaatagcatgttcgatggcattttcaatgacaggctgcagaatcagaggaatgatcggtgtgtcatacagggactcggaaacatttatattgtacgtcaggcttttgcgcatagccatgatggacagataggcttttgcataggatacctcttccccgatgcttgttattgccttcttttttgtacaatacctgtaataatccgccagatgaacggccatttccgttacagcctccggtttatccgccactgtcacgatataggacaggctgttataaagaaaatggggatggatctgaagctgcagctgacgcagctccgcctggtttctgagctgctgttcttttatcgtggacaataccaaatcgccgatccgggataccatctgattgaactgctggaagacataggagaactcattatccggcagcacctcaatctgggaggtgaagtcaccgtcttccacctgcctgagcttttccgtaattattttaagctggagaaggatatttttgtagtataataccataaaaatgaaaccgactgcaagaatcactcccagcagccttgtggttatccccatcatatccataataggctttctcatttccttcaggggataataggcgacgagttcaagcccgttttgtacggctcctgatttgataatctggtatttttcgttgtcaacagccagttcgaaggcttccttatcctgttttttcaccagccctgccagcagatcctgttccattccatcggcagaaaagaggctttgtctgtcaggaagcacaagaagagtccccccggttcccatacctgaagccatatttttgattttatacaggtagtcccgttccatcttaataaagagaaagggttcttcatctgctcttatccagtccgccgaataccgtcttacgtaatacacctccttttcccaatagaaccactggttattttccgccctttccagcattttctgccttacgtccgatttattcagcgtggatataaggtagttttgttccggccagtacaatatgaattctgacatgcccacattgcttctctggcgtctgttcagatactctttgatattttttacacccatgacatattcatagggatcatattcctccatgaccataagctgcagttctttcaaatcattactgttcaggattccgtccgcttctatctctatttcattgattttctgttccagaagggccctggcatattccatctgaatctgcgccacgcgcataagtgattccctgagactgatggcgctgtaccggtataaaattaaaaagctcgcaattatcataatgagaaaaaaaccaaaaataataaaaattgattttatttttttcatgcccaccccaataccggctccgccgtctgtttttctcaaaaaattatagcaggattcgtacctttttactatatgataccgggactgccagatgctgacagtcccggatgcatgcctttatttaactgactgataccattcattcacttcctgggttatttggtcgccgccctggcttttccactcttccacaaatttgtcaaatgcatcgatgggctccttcccataaataatgttggtatagatctgtttttccatagtttgcagctgttcccattttttcttcatggttgccgtaggttctccgttaaaaaggttcgggagcagctcgtctttatgttctccggccaccacatatcctcctgccatatccggcgaggctttaaagtcggccgcagccttgatctgagcactggtttccggggttattcccgtactgacatccatatagggctgcatggtatcgatagaaggcgtatttttgagaacagttgattttcccggcataaacggatcggttaccggaggatcaaataatttggaatcataaacaacggtatccccgacaatatcataatcatatccttccagataaccgtatttgaagtctcctgtcccgaacgccgcgtcataaatccagtcataataggtaaagaaggcctccatattgttgaaatccttattgaacatcagccatccgtcgttgatctgggctccctggtaagcaggctccccgctgtcctgcaggatattgggataggctttaatcaccgcttccggacaaaccgtttccacatccctgaccgaacctatcgcccatggccttccgataaaaatccctgcttttccttcggtaaactgcatcattgcatcccatgcaccggttgcggcggcctcctgaaaaatccatccatttgcatgccactgtgccatccgttccagggtctttttatttccttcatggatggatccgtataccagctgaccattctcatcctcctgccagcttcccggataatgttttcctgcattcgccgaaaaaaggataacgggatccgcaacccatccggtattgtagatactgtcgcccgcataagtaaaaccataggtatcctttttcccgtttccatccggatcctgctccgtaaacgccctgataacctcttcaaattcatctagtgtggtaggtgccttcaggcccagcttatccagccagtcctgtctgattatcatgacctggccctcagtcagaaaaggggtacatgcaatgccgtaggtttttccatccttgatgaccgggtagaaggtctggggatatttatcatatatttccttcagcctgtccggcatgtatttctctatgtcctcatcaattgctttcacttttcctgattcaatcatgtcggctatcatctgagtcccgtataccggaaaaacatcaggaagctcctccgaaccggtaagcgccagacggagctttgtatcataattgcccgcatcacctccaagcaaaatagtttccatcttaattcccagcttttccaccgcgagatctaccatgggatttttattaatgtcctcgccttccccatacctgcctgtgttctcgtccagctgtttagctatacggatcgtcaggaccggatcgtacctgccctccgcattttttgtgctgactgcctccgtccctccgctgtcctttccgcatcccgcaaggactgccgccactgtcaggaccagtgaaatcgcttttaccgctttcttcatcaataccttcctccttctgaaattataatcatatgccgtaactgttcagacaaacctgactgttggcataagctttcctggcaaatcattttctataattcccgggcgcacttattccttaactgcccccataacaatacccttcacaaaatatttctgaaggaacggatacaccatcaatatgggaagtgcccctataaatacctgtgccgcctttatggtacgttccgacatggctgccgccgaagtgggatccagtgccaaatcctgttggtttccctgtacaacaataacctgcaggaaggaagcgagaggataatttttggtatccgacatataaagaatacctgtaaaccattcattccagttccccaccataataaaaagagcaacagtggcgagtccggccttggacaggggaagataaatcttcctcaatacggtgaagaagcccgctccgtcaattaatgccgcttcctccaatgacttggggatagaacggaagaaattcataatcagtatcagattataacagctgaatgcgcccggaagcacatagataagaaaattatttttcagcccgagagtggaattgaccagataggaaggaatcaatcctccgctgaacagcatggtaaaaacaaaaaaccacatgagaggcgttcttcctttaaaatccttggaaagtgcatatccggccgtagtgattacacacatgctgagcaccgtaccaatacctgtcctgagaaaagaaatcaggatggaacggataaaattgttattctgaaatgttttctcataagcaagcaaggtaaagtcaaccggccagaaggtaacgattccgctgttggccgcactttttccgcttagtgacaatgcaaacaggttcacaagaggcagtaagcacagcagggccacagctatcaaaaaaattgtattaacgagcacaaatatctttctgctaacagatgtccgacgcatattccttccccccttctaaaaaatacggtagccggcaaacctgtaggctattttgtatgcggcaacagtaagaagcagccctatcccggatttgaacagccccactgccgttccaaagctgtactgtccgttcacaagcgactgcctgtatacgtaagtgtcaataatatcgcccgtactgtatgtaagaggagaatacagattaaatatctgatcaaagcccgcattcaggacatttccaaggctgagcgtcgccatgacaatcaccattggcataatacccggcagcgtgatatgaagtgtctgctgccacttatttgcaccgtccatttccgcggcttcatacagattctggtcaatattggaaatcgcagccagatatacaatcattccgaagccaaaccctttccagagatccgacagaacggcaatctgacggaacatccccgcctctcccaggaaaaaaaccggttccataccgattttctgcagaaaaacatttatgataccgtccagtcccagaatatccctcagcattccggcaacagtaacccaggaaaggaaatggggcagataaaccagggtctggatgcttttttttaatcccagctgttttacctcatttaacagcaaagccataattaccggtacaatcagccccaatacaatcttgctcacagcaataatgagcgtatttataatcgcctgatacgattccctgaattcaaaaatctgccggaaattatccagtcctgcgaattccgaaccaaagattcccagccagggcttataattctgaaatgccatgataagccctgccatgggaatataacaaaaaattatggcaagtatggctgccggcaggacaagcatatagagcggcaggttacgatggaattcccgtttccagcttattccggcagttcccgttttcccttgtgattttcccgctttgttaatcagcttcaaatctcgttcacctcgttttcgtatttatagattttattataaaagattgaatatccataaaaaacacctcgattttaaggttatgtccccatttttaactatttttagtcatagttcaaagaaaaatcgggctgatgagcggtatattttattctgctttacgtttttttacataacatcaaaatacaggtgaaatttttcagcagttaattcaaacaaattgacaaataaaatacgggcttctataatgtaagaaattatccgtttttttaacacattaccggctttttcattggtcttatgtacatccaatccacatcagacaggagatgcgaacatggaaatccaactagtcttacccgaggaatcccaggcggaagatctggccttacagcgaaacgaccgggaggttgtccgctataccggcgatcccaaatatccttatacgaaggaggacgcactcgcggatatcagaagcttcctggaggaagaaaacaaatcccgtgtcacacgtaccatactcgcagatggacgccctatcggcatcgtctacttctatctgccgtggcggggacagaaatctgtggagctgggatactggcttgggaaacaatattgggggcagggaatctccacttacgctgcgaagcagctttgtgactttgccttccgtaccctggatatcaaccgtatctgcgccagcgccctggaagtaaatgtgggttcctggcgggttatggaaaagctggggatgcgcagagaggggacttttattaaggctatttatcaggacggggagttctttaatgacctttattacgcggttctccgggaagaatatcgcatggaataaaccggaatcgatttttctcagagtatgtgttcggaataactgaaaaggcaattcatttttttgtgaaaaccagttgaactctgttaagagaaccaactggttttctgctgtttcatccgtcctgaattcttcctttcaaaacaatacctccatacattctctgttctcctcccccttaacgatattttaacgttccgcatcaaattttaacctgcttcttattcggaaacggttataatgtaaaccataaatttcagattcatacaagtgtcagacaacacgccgcacaggctaatgaaaatcaaaggagtaatttaaatgaaagatgtctattttctattcagcaaaaatcagctgaagaatagggaagaagccctggaacttattaaacatttctgtaaggaacatgacttaagcttcagtcttccggaaacggataactgctccattgcccgcatcgggggtgaacaatatatgataaatatcgaagaaataaacgatactcccgaagaagtaaattggatggtctgctgtatacatcaaaccaataagatactatcgccagtcggcggtattcacagatgatgctgaaatacggaaattgaaatttatatcaaggagaaaaaaatgaagaaacttatatttaaaggtgctgcaacagcgcttatcactcccatgacagaagacggcaaaattaattaccaggtccttcaggatctactggaattccaaatacagaacaaagcggatgcggtagttatcgcaggaacgacaggggaagtttccactctttctgatgaggaacatataactcttgtagaaaaagcggtcaggcaggtgaatggacggattcccgtaattgccggggccggaagcaacaatacggctcatgccgcatggctgtccggggaatgtgaaaaagcaggggccgatgcccttctgcatgtgaccccctattataataaggcatcccagcaggggctttatttacattttaaagcctgtgcacaggccacttcactcccaattatcctgtacaatgttccttccagaaccggagtaaatattttccctgccacctataagagactgagtgaaatcgataatattgtggcctgcaaggaggccagcggaaatttttcccagatagccaagacggcttctctatgcaaagaggatttaaccatctattcgggaaacgatgatcagattacctctgcattagccctcggcgccaaaggagttatttctgttctctccaacatcctgccggaagaaacacataatatttgttactcgtattttaacggcgatcaggaaaaaagcgacaatctgcagctgaaatatctggaattgatagaagggctttttatggacataaatcccatacctgtcaaacaggcgatgcgtgccatgggttatcctgtgggcggctgccggctgcccttatgtgatatggatcctactaatgcggaaaagctttatgcgatcctgaaaagctatggccttataaatagcggagtaaaagcaggttcgatcaccgtacataatgcgaaaaacacgggtaatattttaagatataatatatagcattcgttttcccataccgggaaatggaaaaacaaatgcatgaaacaggtcatggagcggtaccagatttctgcaggctgcgggaaatctggtacatgcgcagatgtaacttataaaaccggaacccagtactcaatcctgctcctgccattctcatccgtttcctctccataccgcacaaaatcatacctcgcattttcattcagcctgcaggtcgactgcggaaaccattccctgtaaatataatccgcaaccggctgcatactgtcttcctttattccccggaagcaaaagactatatattttgtagcgggcagctccctgccttccatacctttcggcagagcgcctatccgttccacctccgatgccgcataatagtcaaagaccggctgtttttccgagtccgtatcccatcgtgcataatcattcagtccaacgaggaattccctatttatccgatcaggaatgcttcccttcccggcatgcatttttttccagcactgcccgattacattgaaaccaaagcgggtatttttccggtaaccggcaagcaacatccttccgccttccaccatttggatatccatcatcctgtctcctctcagtttcccggatccgtccacagtcattttcagctgtaaggggaagaattcctttttacgccggaaggcccttggactgcatttatacattgctttaaaaccgatcgtaaaggactgctgtgtttcatatccggcaaacagggcaatctccataaccggcttgtccgtaaataccagcagccgtgcggcttccgtcaatctccgcctctgaatgtaggtgtgaacggaaaaaccggaaatcactgagaacatcctgcttaaatggtatcgggaataacccgcctcacggcaaagactgtcaagatccagccgttcttccaaatgcttctcgatataatccatcatttcccgaatcgtatccagatttgttttcattatctgtccctccctatgactacctatacatcggcgtctccggggatttttcacatttcttgctgtatttcctgtaaacattatttgctgtatgctataatgaatctgcggcatgtcctgccgctgcatctcattaaatacaatgtttcccgttggatacttactctgtaagccagccctatgagcctgtcctgtaaaagcggaaacacaataaatattcaccggagggacataatgaaaaaacaacattcaaaagtattttatatcgtacccgtgcttgccgttatactggtaatatcggctgttttacttctcttttttccgggcagcggatctgcttcggcttccggtatcctaagcctgaatacagatgaatatgtgaaggcgatgggggttgagcagttttcagacttgtttcaggatgtgggagacaattataatatggcctatgttctccaatatgccggagaaagcaatctcgattttaagaccaccagcacatatgcggtatatgtacctggcgccggttcagcctccgcagtaggtctgggaacttctggtccggtgttcagccgtcatcttaaactggatctggattcaacaggacagacgggaaatgatgtttactgcattacttcccattcggataaggagatggatttccgggtttatctggatggtaagagaattgatacaaagattgtagatgtggattttaaccccataccatccattgaataatacgccgcctgttcagcatctttcaatccggtattcctggtacagcttcttccgatattccttatttttgatcgctttctgaagatcgtctatacggaaatcggcaagaagcttttgcgacagcgcggcaaaatattcttctcccagctccaatccctggcttttaccctgattcaccccatcattataaagatcatccaatgctttacacatattacagctttcctcctttacattcagtgctgacaaaatctgcgttcctttggcggcagctgccaggaaaagagctgcatccttggaaagacgggaaaaaacatgctcgttttcttttacatattttttcaaagcctttctgtcctcctggcattgaagaaatccgaatacctgccgcagttccgtgtgaagcaggctgatatccatgtccctcctgacggagagtacatggatcggataatcgggcacaaagcttctgagtctgtcactttcctccggaaacctcagaagatcatgcagccgcctgggccttttccactcttcttctccaaaatacaatagcaaagtaataacaggcgttatccggtcatcagggaagaaagccggaaaaccggttttaagacccagccgtttccgattctcctcttccaccctgcgcacctttttctgataatcagccccgtcatactgcatgatccgcaccggagccgtataatcaatcttttcctggttttcaatcccaagcagaaccagctccattccatcctgataatacatctttacaacatcccgcacatgcttatacgcggcagaatactcaggcctgttctgtaccggatcctcctgccgcaggccatgatagtcaatcacctgcctgccgccgtacagccaggcattaaacaggtcggcaaataccggcggatgggacaaataggaagacaaagaaatatcaatttttcccataaacatactgctgtctgccgaaacagacagatttcctccttaattatacataaaaaatgtagaatatacaatatattaataaaaataaaacggaattaaacggaacagactgttccaggaataaaaaagaatagctatagctgatgtgcagttatcataacacagaaataatgaaaaaacaatacatatctgcacccgatttgtgtcaagttttttatcttccccctatgaacacatataaaaaggaaaacatataacgggaacgtaatcccctctatgttttccttttatgatttatttctcaatttctatttcggtttttccccgctgttttgcatccattttctgcactgaggaaaacaggagggaatagcataccggaaccaaattaccaaagctgttttccagccgcttcagcggaaacaaaaggcccgggaaccgcagaaagtccgcgatgctcacccagatagtcctcgttgaaggtaatcgccgttccgtcaggattttcaaacctctgctccggctcaaatgcatagcccaggatatcactggtaataatgccgtccttaaaatcgccaagcagatcatacacatttgttttcaggtaataatgcccgtccttctccaccagttccacggttaccttatttgtctcatcaaccagatttgacttctcatttttgcagggtttcgcgccgttgaaataagcatttccgttcacccaaacaggtaaatgtgaaaaatgatactgggccagctcgcccatattggcaggcttatccatttcaaaccagctgatccactcctcataggtaggatactcatcaaatactctcgtaccaacctcctggttatcctccattttgaatcccatatcttctttcgcttccgtttccttaacaggccagttctgaacgaagatattgttgtagaaacgatcatccccatgcaggatggacataaatcctgccacttcggtacgatggcggatatggtaaggtgtgtaacggggctggttaaggccgtttaccgtattatccgtgccaccgcctacagccgtaaaagcacccagaatcaggttatgtacacaggccacgccttcggtggcaatccgcaggccggctttggaaagcatcacattgttgtcaatcagtgtcgggccatgtcctacttccacgaatatatcctggcacatcatagcgccttctgcctttgtggagccttccggcgcatgattgtcatgcagcaggttctgtgtgattctcgtgccctgcgcctgccagtcacaccagatacccatggtagaatgatggatatgattgcggcggaatgttacgtcgatagctgcatggaacttaatgccggaaatctcggcgccgccgagctgctgcatattgttgatattatgaatgtggttatcctcaatgatactgaatacgcatcccatacgtcctacaataccagcctgttcgcaatgatggatatggcagcgtcttacgatatggctgcccactttttccttcagccatccatgatactgtccgcggcacaccgcatccctctccatctgggtagggcttttcacatgcttgttggtaaaataatgatcattttccgggtcataatattttcccagggaaataccgcagcatttactgttgctgatttcacagtcctcaatgatccagccttttgaccagtgagggccgaccattccgtcctgataagcggcgggaggagcccaggttgtggcggctttgttaacgtcaaagccactgagggtaatataatccactcctgttttggagggcataaagcagttgcggcgaacattgatatccactttttcctcattgggattatgtccctggaaattggcatagatcactgtggtgtcgccgtcttgctcggtataccatttataaacagaaaaatcatgatcccaggaagggagatatacttcacccttgatacattcctccagcgtctcagtttcgtaaagctgacggtcatttaagtatacggcgcctgtgtgtctgactacaggtgcaaaataccagtcccctcccacaaaagtagtataaggattataattgccgaatacgccgttatcaatgcggcatatccagacattcccctggtaaggttcccaggtatctacgggttccgcaccggtaatgacagctcccagaggctgttcgctgcgataagtgattctggcgtcttccgttcctccgttcacaggatccacatactcccggtaaatacccggagcaaccaggacctcatcccccggtccggcaacctttgccgcttcattgatgtgtttaaaaggcatttccttactgccgttgccctctctggcagcggcggcgttcacataaaaaatcatacatgctctccttcctattgtgtgttttttcggaaataacagccccatcacatctgaactgtcatttccgttatagtctgctcatgaccaacaatattttccctgacgggaaacaggcagtctcttattgcttatcctatagagtcattatataatcataataagcacctgaaaatgtcgtatccagagggaaacggagttttattgtatccaaatcagactttttgaagtcaggaggaaccgtatgaaaaaagtcagacagttcatcgataccagtgggaaactgtcacaggaaggatttctgaaaaaactggggattcccaaaacctttctcacctttcataatttaggcagctatacttcggagtttgtagagatcggaatgccgtatatgatcatttatgaagcaactgacagaaagcacggtgaactgaactccctggaatttacggaaagcaataaaaattattttttttcttccgtaagcaggctggatttggaagggaaacgttccctgcattcccatgatttttatgaactgaccatcgtgctggagggcgagcttcatttacagatcgaaaatgaaacggtggcctatcatgccggggaatgctgcctgtgcaataaaaatatacgtcataaggagctgcatgacagcgagtttgaaatcattcttttcatgttccaggaggaatatatcaaatccgtactggaacaggatcttctgtatgatgaggaagggcaaagctgtaccagccacacctttttccatcatctgtttgcggaaaaccagaagctttccttttacagcgcaaaggagtatatcgatttcagaagaaagaccctctttgatcctgatgatttttacaggctgattaatgccatcgtgctggaactgagcgaaagccgttccggaaggaattatatggtgaggggatatttctgccgtttcattgccatgctgggagacgaggagaattacctgatccagacccaccagacaaggatctccaaggaagaaaggcttttctaccaggtgtcccagctgctgcagaacagaaagggcaggatcagccggggcgagctggaagcagaattgaattataacagcgactatatcaaccgggtggtcaagaagcacaccggccggactttgtctgattacagcagatcctttctgctgaaggaggctgcggatcttttgaaaaatacggacaagcgggtgggagaaatctgtgaagagctgggctatacaaacaggagccattttaaccgactgttcattgaacgtttcgggatgacacccacggagtaccgggaattggaaccggatgagtaagtcaaataccccgccgcaagcaacggggcatcaaacttgaaacgccgcggaccttatttcgcataaaacctcatatctccccacacgtccatcagctccgtacgatccaactgctcaacatgtgtctctctgtcatatatcataacaggagacttatagcccgtatactgcggccaggccgaatcgggattccctgtcttaataaagcttacccagcgcaggtgtacatcttttactatcctgtccaccgcttctttcggttcctcctgaaatacaaaggcgctgaatccgtattccggacaattgaaatcacagggtaagtccatggcatgggagcaaagcattccggttttctccgccatctttgacatgaactcaaaacgatacatccacacctgaccgtattttttctgtgcttccgccactttaagggccggcatctgaaaggcataatccgtggcaaaatcaacaaaagccatatccacaccgttaacctttataccatttcccttttcataatattcttttattttttgataccctgaggtattgccgttttcttcaaacattttcctgatcatctcccatgaattaggaaaattagtatgctcagggtgaacaaacatagtaccctcatgtaaattcgtgccaatcatcagccggatacccgcggcgctgcctccggcaatcgcatccagaggtctttcaggcaataaatcatccacggaaacggtggggagaaaaatgcccggattacgatattgatgctctttggccacatactcatttcctttcagcgcctcataagcgtcaatatccttcagctttaccaagtcttccggggaccagcccattccctccagaaagatatccatattccgctttgcggtttctctggaaaagaaacattccggcagggcgctggaggcaattacctgctgaaaggttcctttgacggcgggcgcggccatcagcgctatcatagacgtgccgcccgcggattcccccgcgatagtcactttttccggatctccgccgaaggcgctgatattctcatggatccactgcatggccaatatctgatcggacagtccgcagttgctgtcaaaatccccgcatccgggatagcctgtcacatcataaaagccgaatacgttcagccggtattggatgcttacataaacaatcccatagtttgcaaaagattttccatggtacagttcatcggaagcacagccggtattgtatccgccgccatgaatatagaccaatacaggcagtttctccccctctgacggtcttctgatattcagggtcagacagtcttccgagccttcacagctgccgtcattaaactgtaccgctttatcgccgaatttcccggcgttcagcacccccttccagggttctgcgggaactgcgcgttttaagcgcagttctcctgccggaggcttcgcataggggatccccagaaatgcgatctggccgttttcttcatgtccctgaaccctgccggcggttgtctgtactatataatcactcattttagtctccttttcttcggcgccttcagaaccttgtaccatatgggacggagttttcataggcattcgtctggaaaatgacagtgagcattcgttccacacaggccttcaagtcttcttcagccagtgttccatccttaagcgccttccggatattttcccgatccccttcaccgccgggcataatcaaatcatttccggccgcgatgcagccccaggagctgctgccgccccgcggcattgtggtggtccagtcagtcatgataatcccctggaaattccactcttcccttgccgccacagtacacagatccctgctgttggccgtatgtaccccgttaatcaggttataggaagtcatgatcgccattggctgcgccgcctttacggcaatctcgaagccgcgcagatatatctcccgcagcgccctttcagaaacaatgctgtcgcagcccatgcggttgtcctcctgattgttacaggcaaaatgcttgatggtggtgcccacaccattgcagctttgcactcccctggtaatagcggccgccatacagccgctcagcagagggtcttcggaataatattcaaaatttctgccgcacagaggatttctgtggatgttcataccgggagccagccaccagcccacgccaaactcctccatttctgcggccacagcccggcctgtctcctccagaagcgccggatcccatgtctgcgccagcaatgttcccacagggaatgccgtggcgtactgataatagatatctgtattcgcatgaggcgtatgatcagcgaatataccgccttcgaccgctccgaagataccctgattattgattcctccggtagttctgtccacttcataggacttcatgagccggattcccgcaggtccatctgccataggcacaccgggcacgccatagctttcctccagacagccgctggtttccccggcagctcccggcaccataatgcccgcggaacccagcgcctgcccctgccctttggcgacttcgccgataaccatggcgatctgctgctcctgcgtcagtttttccgtcagttcccgtgcctcttttttcgcttccggctccgaatatgtccttacctgctctgcggcgggtacgtattttacaggcagaagtccgcgctctgcggcatccgccttccacgctttctccctctccagacgcacggcttccgggcattccagttcatgaagtttttcctgcaaaggcaggatatgcttcaccgattctataacggtatctgcatcaacctccagcactccgacgatttccagattattactggaattgcccacccacacaccgtactgccctttttccacaatccaggccgctttcgtctctgagaaggaagccaggttctttgcctggattcgtatggacagttcttccttctcccccggagccagcagctttgttttggcaaatccgcacagtctgcggtactccttttccagtccggcctggggacaggaagcataaatctgaaccacctcccggccagcccagacatttccggtatttcttactgtcactgttaccgaaatctcccccgtctcttccggaaggatcgcgttcgtctctatggaaaaatcggtataggaaagaccgaagccaaagggatacgctgcttttttcccaaagctgtcaaaataacggtagccaatataaatgccttccatataatattctttttccacattgccgttgttatggctgtaatccccggaaccgggaatgtccgaatacgccgcggcccaggtagaggacagctttccgctgggtgtgacgcgtcctgtgactatgtcggccagcgcatgaccgccctccataccgggctggacgatgcttaacagtcccttcagatgggacaacttcaggatctcctgcaaatcgatggggccgccggtatttaaaataacgattaccctttcacagcaggcgtccagataagacagctctgccttttcttcttccgtcaggtaatagtccccctgctgcagaaaccgatccgcatcctctcccgccgtgcggcttatcacgtaaaatgccgcatccgcttcctccaggcattctttctttatagggctgccggaaggcatatgaaacacattggtggaatacacctcaaaaaagcggttgtttcctcgcctccccgcctccgccagaatggcatttttccagtcctccctggcctggcggtaaatcctgccatactcctccagccactcctgatccgtcagtgctattcccgcgtccagaaagccctgatagatgctgaccacttccctttcattcacatctccggagccggttcctcccttgacggtgctcacggcgccgccgccaaacaaagccgccttttctccttttttcagaggcagggctccctcatttttaagcaggacaattccttctgcagccgccctcctggcaatctgcctgtttttccattcccgttccgtcggtctgctgtcctttgttccgctatatgttctgatgcgtttcttccgatccataatatctctttcccttcttatttcccatgctgagttctctcggttccctgatcgtctttatattgcttaacagtcttctcctgatattttttcttttttataaaaggcagttacaaagcatttatacttccgcaggaatttcttttttaataccggatcctccagttcctcaggccttgccgcacgtacagccgccagatcctccagcatgctcatcagccggatttcgcagccattgtcaaacatctgtgcatcctccaccacttccatggtatgcttcgcatagggcgggatccgcacgatacagcccgcatcggccacaaaggcggcttcatcctcaaacccttccagaaccgtgaacttcaccttccctttggtgatataatacagttcaaaataaggatggggatcctggtactctatagtgatgcctgcatccagatttacctcccatacctcttttgctccgctgcattcaaagcgtcctaccttcagcttcagttcccagccgtcaccgcggtgccttgcccaggaaaagccaggctcccgtatttccggtatctcacttttaggaaccacaggagctatatcctgtacctctttctccctggtaaaagaaccgttggcttcccggtacatagccataaattccggttcgtcatatagttccggatagtgattgaggatcatgttcttgttcaggatcccctgctgcatattgatctcctggaacagttcccgccagatagtcccttcctccagaaacacgaaaccatggggcgtatatggctgcaggtgtacgatatcccccgcctgcgccaccgtctttttcccccgtatggtacactccacggatccttttgcgataaagaaggtctcaaatccacgcgaatgctcgtgataatttacctttgtaccctcatggtagatcgtatcactcatctcatttttttcaaaagggccttccggcagatagaaatcattcaccgcctgggtcccttcctccatatggcggatccagtcagatggttcataacttctcactaaatatcttgtatttgcttcttctttcatcattttctcttttccgcttcccggtaggcattgggagtcagtcctgttttattccggaaaaaacgtccgaaataaccctggctggcaaagcccagccggtccgcaatctcttttatatgcagctccgggtctgtcaggagctgtttggccattgccagctttaagtcattgatatattgaaggatggtaatcccctccttctttttaaaaatccggagcagatattcctggctgaaatgcacctgctccgccagattgtacagggatgtgtccccgtccagatgctccacgatatattttttcacacggtttaccgcatcctcagtctgtttttccacactctggtttttcagggcaaaaatgctttccgccacatggcgcagatacccgaaggcatcctgccagttcgcatggagagatacattgtacagattcatgatacctatgcggaaggccagttcttcatacaggccaagacgcttgatccagccgattaatctggaactgatggtgcagtacacctccagcgcaaacaaatcatgcatactttttatgctctgcagctcggtctgcagttcccggaggatctccagcgtattttcttcttccattccttccaggcaatattccagcttccagagtttctgcatgagctcctgttttttcttctccggcaggctctctctgacggcgtcttctttctgtagctcttcagacaccagttcctcttcggacagccagatcatccggtcacagatgccggtaaattcctgaaggagttggccgatggtgaccggatgggctccgataagtatggaagccgcccggccaagattctttttcaaagccttttggaacagttctcccgcccctgtcagcatttttataattgtttcttcattcagcagcttaatgggctgcgcaagcactacaatatagtttttgttatactcaaaaaaggttccatgcataaaatccagaaagtacctttcgataagctgatagcagtcctgtgtgctgttctgctgttcctgatagctttcgcaataccaggcttcatgcctgagcacgatgtagtacagcttcttccccggatccagctgaagctgcaggcgctgcgccaattcttccgtcaactgggacagccccctgcggccttcaaacagttccaccaggaacatacttctttcatgcaccagaggcttcttctgctgctccctctgaaaatccgtaagccgctccagcagaaggctgttttccaattcctctatggattcccgcagggcttccagtatcttatcatcatcttccgctttcaggacatatttggcatgcttatgtaccttatatacataatcaaaatcggaataacccgtcagaaagatcactttacagtaaggccatctttcccggatgatgtcatacagctccagccccgacatctgcggcatattgatgtccataattacaacatcaattttacgtttttccagtatgtcctgtgcttctaccgcactggacgccgtggccagatcaagttccggcgattcttccatggacaggagcccatagacatcatcacggatcattttttcatcatctactattaatacactgtacataatcttatccccctctgtcacggagcttaattcctgtaatgagacggatgctccacacactttaaccataggtgagaaggaagtgcccgtcaagcccttttgcccgttcgaatccgaatatcaggcggattccgcctgcccgctctgaattattctttcacacttcccagcgtcataccggttataaagtatttctgcagaagaggatataccagcaggataggaataatagccacgaaaatctgtgccgccgtaaccgttttctgtgacacattcgtcatggcgctcacgctggtcaaatcaatgctggcaatatccaccgactggattacatttctgagataggtctgcaaaggatattttgccgtatcactaagataaatcatgccgtcaaaccaggaattccagtgatttaccatggtgaagagccctactgtagcgagggagggctttgatatcggcaccacgatcttcgtcatgatctggaaatggttcgctccgtcaatcagcgcggattctgtcagtgcataaggcagtccccggaaaaagttaagcatcagtatgatattgaaggtctgcaccgcactgggtaaaatcagggaccagatgctgttgtagataccgacggattttaccacaataaacatgggaatcaaaccgcccgaaaaaaccatggttaccataaatacccacacataatattttctcgcatgaaatctctcatccggctgggacatggcatatgcgctgagaattgtcagcgccacactgagtacggttcccagaaccactctgactaccgatactccaaaggactggaagaattccggttttgcaagaatatactgataagaatcccatgtgaaatttacaggaaatatcgttacccatcccgcctgcgctgcagaattggagcttaaggaaagggcaaatatatgaatgagcggaaaaagggaaatacacataacaagtgtcaggaaaaaatagttgattcccaaaaatacttttcttgcaggagatgattttattttcatagcggcctcctaaaaaattcgatagtttgcaaatttctttgcaagggtgaaggacgatgcgatcaggataaaggaaatcactgacttaaacaggcccactgcggtggaaacgctgtactgcagattcagcataccgagacgatatacaaaggtatccagaatatcggccttctgatatacaataggactgtacagattaaatacctgatcgaatccggcattcagaatattacccatgcccagaaccgtaaccagtataatctgaggaagaatacccggcagcgtaatatatatcatctgcttaaaatatccggccccgtccaccttggccgcctcatactggctctgatcgatagccgtcagcgccgcaaggaagatgaccatattatagccgcaccctttccatacgtcggatgccaccagagctccccgaattgtttccaggctgcccaggaaatatatgggctcatgccccaacgcggagagcagagtattcacaattcctgtggtgggagaaagaatatccaccagaatacctcctaaaacaacccaggaaagaaaataaggaacatatatgatcgtctgtgtggcctttttaaatattttattattcacctcattcaacagcagggctagaatcaaaggaacgattatccccgcaacgattttcataagtgcgattaccagcgtgttcaccagtacctgccggaaatccttcataccgaaaatgtatttgaaattgtcaagtcccacccactgtgaggtaaaaaaccctttcatccctcccgacggcacaaagtcctggaaagcaataacgattcccaccataggaagataggcaaaaataagcagcagtacaatagccggaagcagcatcagatgcagcggccattcccttttcattatggaacctaaatcctttttctgtttcataaaaaatcccttctttcctctgaaaaaatgcgcaaaaagggagtgaagccttttatgccccactcccttaaaagactacttaccggcgtaccattcgttcacttcttccgttattttatcaagtcccagagaattcagttcctttacaaaatcatcaaaggtatctgttgtctcaatccccataatgacttttgtataatactccataaccttatccgtcacggttgacatcttctgccccattgtgggtgtaggacctgtggtgaacttatcccacatgaacagatcatcctcataataataattcatcgtgtcataagcggacatatcattgccaaaggttttcattccgccgtagcttgtcacaatatctcccgacagataattttggatatcattatagcttaccagttcctctgcagtcagggaagaactgtctccgctttccagcgctgccacaatattattgtgaattgtcaggttcttcagcgggaaccaggtcttcagcataacccagtgaagagggaaattcagaatatcattggaatcttttaccagataatcattatactcctcacctgaataagcatatttatcaacccagaagttcaacagcctcaccactgcctccggatgctcacatttcttattgactacaacatatcccagtatggaaagagaaatctggggctgtgccttcgattcgtctgccgaaggtataggaagggaaacccaatcggcctcaatatcattctgaactgtggaattcaaaggccagttagcattccacatcagaccatactgaatacctgcacgaccggaagccgccgcctcagaggctttcacctcatcattggatgagaaatcctgttcgataaggccttccttatacattttcgccagataattcagtgcttccttattttcctctgcaacggaaccatattcaagcctgccgttttcatcttcaatccaggctgtgggatatgctccaaaaccattgaatagtccggcgccgtcgcccagcccggcattcaggaaattattatggaataccattccaatcgtatcatttttaccgtttccgtccggatccttatcccggaaagcaatcatcacatcatagagttcatccagggtctctggcatttccaggccaagcttcttaatccagtctctgcggatccacaacatcggggctttgtcgatggaggaatccaccagcggaatggcaattacttctcctttgtcggaggcggattccagagccgcttccccttcacctgttgtccatgccattaattcctcggatgcatatttttcaaatatctttcctatatcccggttaataaggtcactctttgcaagcagggaaagctgcgagctgtttacaatcatgaaatccgggatttcaccggaagcgatagccacgctcttcttctgctgggaatcatccgccgtatttgctgcaaaccactgccagtcgatggaaatattggtttcctctgtcatcctggtatagtagacgctgttcagcatatcctcctgtttaaaatcccccataatcgccggcgagatttcaaagtatgaggtaagcgtaaccggttcttcatacttgaatctggggtctgctgttccatcttctgcaatgccggccgccgaattgctttcggcttcgcccgaacctgcagactggcttccgcagcctgcaattgttcccactgcaattgctgctgccagcaagagcgcaattttctttttcatgtgtgttcctccttgtggttctcggtagtgtcaagtctgacactccgtttttattaaaaaccttgtattttcagggattataccgctttttgaaaataaaaaagcaatgacctcccctttttggtataatgtagtcaccacaaccaacataacctaaggatggatcattgctatggataacattatactctatttacttactataattcaagaacaatataatactatctgctgcctcctgaatctcatctgcagatattttcccctcagacagtgggccttcgatgattcccactcccctaagtaccagaagttcaccaccgaccgcctccctctcatcaaaccgttcatcaaacaggattggcaattccttctggagtactatctctggaaatacggcaaaccggtcacacccgttcagcgccgcaatggaaaatccatcccggaagatgtcttctgtccgctttgtggggcacctcaccactacctctacgacaacaatggcggcaacggacagtaccaatgcaaaatctgtggacagacctttgtcaccggcgatgttgtcacctcgcctcttcgctttgcatgcccttactgcggccactccctcgtccccaagaaagaccggaagttcttccgcatccataaatgcgtcaaccccaggtgttccttctaccttcataacctctccaaggttgacaagaacctcctggaggaggattacgacaaaaacaagtataagctgcactacctttaccgggaattcacggtggatttcttccgcatggacttagactccctgcctaagaattcctcctccctgaagttttccaaacataacgcacacatcatgtccctgtgccttaccatgcatgtgaacctccagctttccctccgtaaaacggcacaggctctttatgacctttacggaatcaggatatcacaccagcaggtcgccaattatgccagaactgccgccattgtcattaagccctttgttgaccactacgaatatccaaagtcctccatctttacggcagatgagacttatatcaaggtccggggcatcaaaggctacctctggttcatcatggatgccgcttcccgttccatcctcggctaccaggtttcagacaaccgctccgtcgggccgtgcatccttgccatgcgcatggctttccggggcatgaaaaggctgcccgaaaagttccggtttattgccgacggatatagtgcctatcccctggccgcccagcagttcgcacgggagctgggggacagcttcaagttcgacatcacccaggtaattgggctcacaaacgatgacgcggtctctaaggagttccgcccctacaagcagatgatcgaacggcttaaccgcacatttaaatccacttaccgggtcagctgcggttacgacaattataatggcgccaactataacgtggcactctgggtcgcttactacaacttcctccgtccccataagcacaaccactaccgggtgctcaatccggtcgatatgctggagggtgctgacaacatgcctgggaagtggcagctcctgatcctgctcggccagcagaccattctccatttacaggagcaacaggaagccggcagcatctgttcttagattccgggccggaggtaaaaacgcagccatcccgaagggacctgcccttgatggcacgccaaaacaatgctatcatgctgtgacgcagacggtgaaatcttatctgttcttgagttcttcgccgtcggtaagacgttcagagcattgttttggtgtgccgtcaagggtggcggacactgccagtgtctaaatatatctgcaattttcaaggttcatttatgccgggttccccggctatcggttttcataaatcccttgacactacctggttctccgtccttcggagttgtttgttatcatctaaggacagtataaaaaggaatacggaaatcaacaatgaaacaatcttgatatcccttgtcaaaaattgacctgttccaatatatgctccgctgcggtgatcccactggtaagagccaggccgaggcaggctccttccgtatcataatagggcgcacagtagcagcttccattgtcaacacctgccgcataaagtcccggaacgggatgctgcttcccgtccagcactctgcagaaggagtctgtctttacaccgcccagcgtacaccaggcgctgggttcataagcaaatacataaaacggcgtttttcgcacaggttttaaaagccagctgttctttccgaattccgtatcacactgagcttcacacataccgttatattgttttaccgtttcctccagaaaaggaagggaaaaatgctccgccgcctcacgcaggctgtcacagcgcagcgcccagccctctccgatatccttttccagatcctcacgaaaaggccatggacctttgtcgtgtaccgtttttcccgtctcccagtccccgggacgtccataataatcatacacagaccgggccgcgcgcactccctggtagaattcctcgtccagcaccgcataatagcttccggcacgcagggtgatctctcctccaacagacagcggctgatccgccagcagctgttcgtccataaaccgacggccctccctgtccaccagcagcccgcctgtcattgcccaccgcatatttccggggaaacggcctttcatacggctgtgccagccgccgaactcccctgcacagattccccagctgcgatcctccacaccgccggccctcaatgccatagaaatccctgctccatcactgagacggctgccaagaggccctactgagatatcaccgaagtgctgtttcagcatctctttatttcccagatatccgccgctggctatgataactgcccttccatgataggataccatcctgccatccgccgtattctctgccgctacgccgcatactcggccgttttccgccagcagctcttttgcacaggttcccaggaccagttctcccccatattccgtcagcttcttcccaagccgttcccatcgttccggcgcaggcgtatcaaaaaaatgcctggcccgaaagcctgcatggtaaagatcctccgtcagcctcatatggatgccgctttcagtcagcaatgcttccgcctttctgccgtttctgatgcagcggtacagcaggccgccgtcaacagtgccgcgtgaaaatgcatacatatggcgaaacatggtttccgccgtcacggtacatttttctttttcctgcagcagcgtatccgccagggatgggccgcccgccctggccgcgttgcttacggagagatgctttcccttttccagcacgatacagctgcggcctgccttagctgcggtaagggccgccatcataccggctccgccggaaccgataattaccacatcatatattttcatcccaatcctcctcattttttccctgctgtctctatattcacccgatatcccccattctgtttcttccggttttcagttcacagatctgcccggaaggatggataaagtttccgctcatcccctccggcagaagaacttcataacacattccatgttccgtaggagtataactgaattcaatggctccatattcggtaatcacccttccttccaaatcaggaacataatccatatgaggacatatgtccatatgtgcaggatttcctgattccctgcggataccggcaatcacactgagaagttcatacatgggaagcgcactccaggcatggcattcgctcctggaattggcaggtgtttccgggcaggtgacacaatgctcctccggcagccggatccaccagtccatctgcctgccggtcagctcatagcagccggctttctcgcaagcccggaacagttcatagcaggtggaaaaatagcagcgcagcacatccttttcctcaaaggttctgcgcattacctcatgtgcttcctcccgggcgagcatgccgtttaataccgcccagctctgggcatgctgtgtaaattcctgataagaggggccttccctgtacatccctctttctgcatcccagcacagctcctgtatacgatccgtaatccgtttttgcctttccctgtattcaagagccaggccgggccggcctgtggcgtcattgatttcggctccatacagcagcgccaggccatacatcaggttaatgatggaagacggcccttcctttacggcgcccggacggcccgcggactgctcccagctctcctgccagtccacaaaatcccaatatcccagattttccaccaatccagtagatccgatgtgcctgtcataatattccaggatgatatccacatccgcacgataccgtttcagaatctctctgtctccggtacgcctgtaatactccagaagcatgaaaatataatgcagggaaaaggtagatatgatctgcttcggattactgggagcccttccctggataagccctgttggcagcatggagtcatgaaaatccagaagcgcttttttggcaagcttcgtatccacactgcatacgaaggtaaacagggcctgcagcctggtatccatcggatactgcatctgttcccagaaggggcagtccatataggtttccatcatacagccctgcagggtatccacacacatcttatagatcttttccacccagggagcctgcgatttcacataggaacccggttccaaagggtagccggtcttcaaaagctgcggccggtaaaaaattaccggttcctcggccgcctcaatctctattttcaaaaaccgcatggtacggtaccaaaagggttcatagaccaggtgtcctccacctggaataatcgtatccctctgtccgttctttcctatttccccgtttatgtaatcgtcccgctttacctcatccacaccctttgtaaatttttcaaaataagtaaaggatagcttcgcgcctctgcctccttcgatccggtagcggaaataggcattgaacagcccctgcccgtcaaacagcagagtaagcctgttccccggccctacgatgacccgatccgcatctcccagaacaacttccccaagttccttaaccagtacggacggcctttcatacagcagagggatcggacgttcctccatcataaaggtcttgagaataccaaacatcatctcaaaaccgctctttacctgctccaggcagtcaccggcacgccagccggcatcgtcaaaatctatctctttccagccggcgggagaacatctgaaatcaatcgtttccgtcagggcccccatgttgccgttaaccacaggttcctttgtcaaataatacgtattgtccagccacaccctccagtccgccttaccggtcgtcacctccgcaaggatcctgccttctttatcctttaccgcgccttccactgccagcctgtgtcctgcgggaagcgtctgcacactgtttaacggagcccggttatctcccggacctcccttcacgtacatgctgtcacacaaaagtacctgtaccgccagcacattgccgccctgtctcagatattcccccagggaaacggtctcataataatgtctgaaggggtcactgcggcaggggccggaaagaaccggctgtccgttgacccagagacggtatctggaattggcggaaatgtccaccgtaagctcccctttctgttccaggacaaagttcagacgataataaacaaaccgcccgttcatatccccctggaatattctcttttcttcaatttcctgcctcggcagccccagccacaatgcttcgttccacatggatttttcctcctttttcacccggtccgggcttttactgtaagtataaagcagccgggatcgatcaacaataaaacattcttgacctatcccggcaaaagttgacctgttatcaggcctcccgattatatttgtatggacatatcaaaccgcaggcaaaccttaagccctcccatatcactcttttccagcaaaatgccgctggtctccccgaaggccagcttcagccttctttcaatattggacagcgcatggccagccgcccgtcctttataatcctcaatatactcctgcatctgccgtatattctcctcgtttcctcctcctccgttatcctcaatcacgatagtcaggaatgccgcctcaatttgatagcttacgcggatgcggccgtccttcagaatatttgccataccataattataggcattctcaataaccggctggagaatcagcttcggcacccggtagccggccgcctgttccggcaggactcctctatccaccgtgattttatccccgaaccgcatctgctggatatcgatataattctccatatgctccacttcacgggatagcgggatattctgatccacttctttgttcaggaaacggtaatacctggccagagaagtaacaaactgtgtaatctgctcgtaggattcattttttgccataatccgtatgaggtaaaagctgttatacaaaaagtgaggattgatttgggactgcagctgaatcaattccgcattctgcagcagcttcccctgctcccgcacattttctatgagctcctggatacgttccaccatcttgttaaaagaagaataaatatactggaattcatcctggggcttatggaaaatccgtatttccagatttccctcctgtacctgttcaaaagcctgcaccaccttcttaagtggcttattgaccgccgtatttgtctgaaagatcatggcggaaaacaatccgccgatgaccagcagcaccacacccataaccagcagcgccgtcgccgccgctccgtctattccccatccgttctggtatacaactaccgtaatcccatatctgggcaggttttccgatacaaataagtaaccggttccctgacatctgcccttgcccaggaagctttctgtcccgcccttctttgtccatgcctgataccagcagtccagaagaggctctttttcttcatcctcaggtatcagctgtattttttctccatcatccagtacaaagaaagccccatcctgttccccgtctccaaacagggcaatcagctcctgcagataatcttccgccagggtaatgcagactccgaagtcaggcacataatcttcctcagtcgaatacgtcaggggatacagcagttccatctgtacctgtccctgatcgtataccaggttacgggccgtaatatccttcgcccgttccctggatacgtattcttttcttctgtacccctccgccgtgcttaattccatttcctgcatgggaaatgccacggtgatatcaccgataatattgttcatggactggaagctctgcatatttccgattacccccagcatcagctgggatctctcataaccgttcagggatatatcatatgccagggaagagatcctgctgtcactgaccagattcttctccagatcatatatgatatccagctgctgttccagggaggatacattgtggagtacagttgtccgcatggcattgatttccccatctctctgctgttgggcatacttcaggaaaatcaggatcgtgctgatatagatgactccgatgataattacaaaaagaatatacagttttttaaaaacacttaccatgccctgcttttccatatctcctcccgcatcaggaatcgtttgttcggatgaattgtaagcatttgtacctcctcttaagatatgtaatagcgtttttccttactctaccatattaccatgctgaaacaagactgaccagtaactgttttacaaaacaacaaaacgccgcacaggtttccctatatggcgttccgttttaattttaaattcaattcacataagtatcaagtcccctgaagatccgcttcaccgtctcataagacagcttgggcctcctatactcatccacaatccctttattattcatggttctcggacgcgtcccgaaccagctgtcacatactcttccgtcgcagaactgccagacatagacgccgctgcagccctcctgtccgaataccgcagtcagctgtttctgaatcgctgaagcctgatattcctccgaccacttcacctctgccggcgtacggtaaccataaatggcccctgcgccgatctcggtaaccagaaagggtttccctgtcccttcggttttctcctgaacccaatcatacagctccttcagataaacatctgcctgcgtatcatgataccacagcgggtaaatattataggaaaccacctcaggcattccgaaacagatatccgttttaaactgacagctggcggaagaacgcgggcggctcggatcgagcttcctgatgagatcgtattgtttctgataacagtcttttccatactccgtatggctggcacactcattcagaatcccccatatatagatggaaggatgattgtaatgggcttctatcatttcccggatgcaatcctcacattgtttttcaaaattgggattgcgcatatctttttccgacaatccccttgcatggttctcttcccatacaaggaaacctgtctcatcgcagagatccagaaacaattcatcgttgggataatgggaggttctcaccgaattggcgcccatatccttcatcagcattaagtcctgctgcattgcctggaacggaatggcacagccaaactgcggatgatcttcatgccggcagaagcctttgattcttattttacgtccgttcaaaaggatatcctttccttccatacgtatttcccgaaatcccactctgtcgatccagtcgtccatgtcatttcccatgtcatcctgcagcactgccgtcagatggtacagaacaggattttccggcgaccattcctccgcctgtccgcagggcaggttttcggcggcaaaggctgctttgctgtccggcccggcctccacaacagccgagtggatttcctgctctccaaggtacaggattaccttccctctgaaaaaatgatccgaaatattctcaagctctccctgcaccgaagcataccattttccgtccttccggacaggggtaaaatggactccggttatataactatcattcagctcctccagcaccaccggacgggtgatcccaccgtaggactggtaatcattgggaacatgcagggcagactgcggcccgaaggaattatctgctatgaccttcagatgatgctttcccccgcccagtccctttaccaccgcagaaaaaggtgtataggcattgtaatgggaagcaatctccctgccgtccagataaacctgtgccgtatggctcacccctttgaattctatgcgcacatttccggaacagctgatatcccgttcatagcatgccctgccccgataggttctcgtatccggacagctttcccagcagccgggtaccgccgcctttcctttaacggcctcttcttttccctgctccggcaacgtgcaaaaatcccagaggcaggaagaaatctcctgtgttttcctgattttatgtgtggcaaatgtccttatcatgctgtataacctcctatttttttccggctgcctattctttgaccgctccaatcatgacacccttcacaaaatgcttctgaataaaagggtagatacagagtataggcacggtagagacaatgatcgtggcatattttatcgtctgtcccacatcctccacgtccgtctgccccgtcatggccccaagctggcttcttgtcaggatatcgcgcaggaatatctgtatgggcatcttatccgcatcccgcaaataaatcatggcattgaaccaggaattccagtgtcccaccgcataatagagcaaaataaccattatggtaggcttggctaaaggcatgataattcggaacaatatggtccagtcacccgccccgtctatccgcgccgattcctccagagactggggaatcccttcaaagccggtaatcataatcatgaggttgaaggtgcttaccgcccccggaagaatcagggaaagccggctgttaatgagccccagatccttaatgagcaggtagctgggaatgagcccgccgttgaaatacatggtgaaaataaacataatcgtgagaaaacgccggagcatgaactgttttctggataatacataggccgccatgcaggtagccagaatattgaccagggttcccgcggccacataaaaaatggtattcaggtaaccgctgtaaatagagggattgacaaatacttttttatatgcattcagggaaaatcccaggggcttcagcaaaaggctggagtttcccatcagctttaccggatcgctgaaggatgcaaagataacgtataaaaaaggatacagggtcatcagcgaaatcatcgccaatatgattccgtttatcagacggaagccccaaccattgctatttttctttttcatattgcttctcctaccataagctgtgttctgtcagtcttttgcatattttatttgcacaaaagagcagggtcaggttgatcacggaattaaacaggcccactgccgtggaaaagctgtagctttgatccaccaggcccttccggtaaacatatgtggaaataacgtccgcggtttcataaatagaggaattatacagcagaattattttttcaaatcccaggttcatcatattccccacccgcaggataaacatggtgattatggtgggcagaatccccggcagggtgacgtggagcatctgtttgaaacgtcctgccccatccattctcgcagcttcatacagctccgaattaatccctgcaatagcggctatgtaaatgatggaaccccatccgattccctgccagatatcggaaatcacgtagattggctgaaacagggaagggttcatcatcagattctgcttcggatagccgaacagcgtcataatctgtgtcaggaatccgtcggtagccgtaaactgaagcaccattccggcaacaaccactgttgaaataaaatggggcatgtagcttaccgtctggacaaactttttatatttctggcttcgcacctcgttcagcagcagggcgaacagaataggcgccggaaagccgaaaacaagatttttcaggttaatgctgaaggtgttgcggatcagcctctcaaaatatacactcttaaaaaattcgccgaaatgctttaaccccgcccacggactgtgaaaaacccccagcttcggcgtataatcacggaatgcgatctgtgcgccgtacatgggataatagcaaaacactagataaaaggccaccaccggcaggatcatgagataaagccctttatgctttttcatattctgccagagcctggcagaaaaactaactttcttcataaatgctccttttattcaggcccgcattccgtatggcacctcccgcgggcctgcggttatacatgttatcttgccagatacctgtcatattccgcctgtctgatttcgatcgctctgtcaatattcatatttttgatattttccacaaactgagggaaattttccagaggctccgtaccaaggataaacttcagtttaaattcatccaggtaggtctggatatccgtcatgatggaattgtattcctggacctcttcattcgtcatggtctgaggcggcatatcctttatgggtgcatcgggagtggcccatacatccagagactttttctggacatcataggcataaccgcccagcatataatccttttccaccaggaacggcttattattgcagccggcataaacggagagcgccttctcaatggaaagtccatccggattatgcaggacaaaatccgtgaacacaggcttcccgtcaaccatctcgtaggtgacgccttctttgccgtaattagccagcatatttccctcttcaccataggtataatcaagcaccctggctgccgcttccggattggtacaggtagcggaaatcacaccgccgatgttgttgatacggtagctgctctggtcaacgatgaactgatcccctttgttcataaccggattgggagccggctgataattcatattcttgttttcttcctgcattgtctggattttccctaatgttcccccggtatatccccacaccaggcctgtcctttcacccgctatttttgcaaaaaatgcgtctgcgtcctgcgtaaaggcgtcaggatccagaattcccatattcatccagcggttgaacaatgtgaggaaatccagatatttctcttccacggcgccgaagtgaaccttattatccccgtccacatacataccttcacggattccgaagctgtttaccataatattgtaattgccgtatataaaggaaaatgccgcgtcacagccctttttctctttaaacgcaaccagtacatcctccatctcctgtacggtttccggcatatccatccccaattcatccagccagtcctgacggatcatattgccgttgaataccagcggggaatccggcttccggatcatgggtgtccatgcatataagccttcattatttttacagagcttatccacttccggatccgattccagataagccttgaaattaggaagctttccagcgtccatcagatcatttaagggaatgatggaaccgtccagaagcattttctgaacgcctcccggaaatgtggtgtcgtattcaataataatatcgggaagatcatccgtaccggcgagcagggataatgcatcctttcctcccgtgctgtcgaggaactgcaggtccacattgcaggactcctcaatcgcctgccagtattcccagtccccctgatcactgtaaaggtcgccgttcgtccagtatgcccacacgctgagtaccggcttttccccttcttccgtctgctcactgcttccggcattcgtttctttattattggaagaggactgtgcatcccctccgcagcctgtcagtatggacgacagcatcattgccgctgccaatgttacagaacatattctgtttaccaatttctttctcatttttatactccttttccgcttcagctgacatcaattcaatataacactgcataaatacccgaaccggcgcgctttcgtttcgatgtacgaccaatataccgccgtccgcagcctgcgtaaatcctgcaaatgcccacttatatgactctgcctgaatttttcagaaaaataagatctgtttagaaatatcatactggaatttttccctcttatgttatacttattttatcatacgataattgcaaagggtgaggggttttatgcggcagatattccataaacgagcaaagaaaaaaaggaccgggttattctggaggacattggtttcctatacgattgtcctcgtgcttcccatactgatctgttctttttattatttccacagctacaatgccctgaaggaacgaaacaggacgaaccagcatcttatcctggaaaattttgcggagcagatcaattccgctttccgggatgcgattaatttaggctctcatctgcagctgaataaatatgtgaccgccctgtccaataataaaagcacgataaattccactccgcctatggacaggtattacctcaaaaaggatttggcttccctgcaggtatccaactcgttaatccagcggattaatctgtattttccgggttcggaatatgtggtgaattccgcttccacattttccacctccctgtttccttatatggagcccaaaggctacagcctttccggaaaggactgggatgcaatcctgaaaagactgcagaccgagcgcatcgtatgctatgcttccgatgacagaagtttccttactgttgcagaggtcctccttacggatatctccgggcagccgctttccatactggcaattcaaatcgataaaaagaatctgctaaacaggcttcaaaacaggcttcttctggagtctccctgttcctttgccctgatcagtgcggacgggcccctgctgtccactgaaaataatgagatcagcctctccggccttccttttgaaaaactcgtcacagccgtgccggaatcctccgtatatgaagtgcagacggaagaaaagctgataatcgactattattccctgcagatacccggaacggccctgatttccgtcaccaaaaaagctgattaccaggcccagacggcccagctgctgaaaatcatggtgctgaccattctgttctgcgtcctcatcggaatcgtggttattatgtattattcaaggaaaaattacgaaccggtatcccaaattctacaatttatcaagggtaccgatcagaatatggagcctgaaaagaatgaattccattatattatgaaaattctctcacaaagccggaatgaaatagaacgccagagaaagctgttgaaaaataattatatgcagaaaatattctccggggaaatcgcttttgaccagatcccggagcaggtggcggagcagttttcccttaatctcactgattcctccgcatgtgttgttttgttttatgtggaaaggacaggcagctttaatgagccggaaaacgttttggatctgactgcctttaccgttgaaaatgtatttcaggagctcctgtccgaacagttccccgataattatttcagtaaccggggacagaaaatttccgtgctgatccatatcccggaggaggactcccagccgcttgtcctgatagaacagctgaccagacatctgcttggtttcctgaaggattcctttcagctgtcactgcgcgccggcatcagctccctccgtccgcaaaaagagattcccgacgcttacctgcaggcagataccgccctggaataccagcggttatttgaaaccgggaacatctgctgctatgaaacgattccccaaaaacagctgataggctctattcccctgaatacaagtgattatgtggtcaatctgatcgtttccggaaacaaagcacagataacggattatttccgggtgctggaaaaaaatatggagaaatgtgtgttatcccgggcggatgcccaaagctgcttttatttcttttatcaggccactgcaaaactgcagctctactgccagacccactatggcctccagcttgacgcattggatttcctggatgactcctttttttcacaatccctgcccaaagcgctttcacagacacggcaggcttatctggccgcaggcgaagagctggcggaaaagagcaagaacccttcttacgtacaatggggaaaggatatctgccgctttatcgaaaacaattatttcgacgccaatatcaacctaaatacggtcgcagagcattttcgtatatcaccggcatacctttccaaaaagttccgggagcagtatcagaaaagtgttatcgattatctttatgaagtccggatatccaattcggtcgccctgctcagggaaactgatttaaaaatagccgatattgcccagatgaccggttttgtggacagtaatgcttttatacggatattcaagaagctgaaggggactacgccggggaaatataaggaaagcaggaattgaaatttctcttaaaggtaccggaaggaaaggttctccctttccttcttagtttatcatctttttaaaccacggcagcctgtcaatcggaacctttactgagactgtcttcccgccctgccataattcaccgcggtcatccttccagttactagtgtatatcggtaaaacagccggccttctgctgaagaccggctgtctgccccttaaaaccttaatgcggaattcgttggttctgtttcatctgagcctcaaaccgcagtctttccgtatccatatttacatttacttccggattttccctggatatcttcatgttttcttttgctttgcgttccggacgtttcccctcgatctgacgtttaaaatcccttttgcgcagcagactcatcgtcacagaccagataaccggaacaataattaaaagtgaaagaagcaacagcagccactgtacatcagtcataataatatccctcctgtcttttcaaacaacttgattacctttaacgcttaacccttatattcttattttaccataacaaaataagacaggacagtaattgttcataaattttcttatatgccgacagtttattttcatgagagctttccataccgacattttaaatcaataccttatacagagatgccgccgaagctgcttcgtcatgtaaagcagcaaaatagtccccgattggtatccaaatgaacaaaaagatccatacacaatgatataaagttataatacgaaatgagctgtttgacatttccgcccactaatattagaatgaaaaaaataaatcaagttcagccgccactgacaaagaaggctgagcggcggagggcgttctgatgtttaatgaaatctgtatttatgaagcaaaaattgacaaacaggatgagattgaagctcttatgaaagaggtcgcagaattttatctttctcagcccggagttattgatgtaaagtacatcaagcgtacccatcggcaagaggattttaatgcggtgaaggaagggaagccgcccatccgcctgacgaaatgggtaggcaaagtcacttatattttacactggacacttgaaaacgaagatgttcacgcacaagtgtcccggctcggattggaacatttttataaacggtggaaccgatgccttactaccatgcctaaaatcctgcttggtgagaatatcgtgtaggcattttcctggcttaaaatacacactgcagcaatctttcatacacatcctgaggtatcggcttatagaacacatatccctgcaccatatcacaatgaagactgcgcaggatttccacctgctccatggattcaatcccttcggccaccgtaattatatcaaactgcctgaccacgcggatgatcccctccaccagcaggcggtccttttcccttgtggtgatattctggaaaaacaaggcatccagctttaaaacatcaatatccagattttttaccgtatttaaagaagaatagccctttccgaaatcatcaacggaacaggaaaagccggcggctttcaatttctccacgatgttcttcataacatcccagttatcgaacaggatcgtttccgtaaattcaatttccaacagtccgtcggggatttgatacctgtctctgatttccgtataagcctgcacaaaatcactgttataaaactgcaggcaggatacattcacggataccgggagaaccgtcttcccattgtccagcagctgacgcagccagacacaaacctcctcaaatacataccgatccagcagcggaatggaatggtttttctcaaatacaggaatgaactgatccgggggtatgatgctcccgtccggcttctgccagcgtaccagagcctccgcacatacgattttgttcgtttccaggctgactttgggctgatagtatactttaaattcgtgattgctcagggctttctccatgctatgctcgatcagcttttccgcgcgcagctgactgcgtatcccctcatcgtaaaaccggtatttatctccttcgccggcctttgcccattttctcgcataattggcccggtcaatcagcccttcaatggtcagctgttccccgacatcctccagacagcagataccgcagcggacaggaagagaatatttatctctggaatcctggatatattccataatcttccggtccacctccagctggcggcgaagcacattttcttttgtgtcatagctgcggagggctatgaaattgtccgcattgacacggcagaaggtttcctcctccttcatatcctcagtcaaaagagaggcgtatttcttcaatatcctgtctccccattcatagccgaacacatcattgatatagttaaaatcttcaaaatccatgtaaaaaagagcatacctctttccggcgccttcacccagcagcttctgcgcaattaccttaaagcgctcagccgtataggcctgggtaaggatatcccttcccgccttgtcattcaggtctctgtttgtatattccagatgcaggatccgcctgatattcataacaaagaaaagcagccagaaaacaacgatgcacagaagcagtcccgccgttacccgtaagatataaagcatttgtttattggaataggcttccgcagcaaaaacagcctgattagacatttcaaaatagacttcactatattccaataacgcattttcggttgatttatccttccggtaagaagaaattcccgccttcaaatccatccacaattcctggagcgcatcaaggcattgccggtattcctcatcatccagatggagcaggccatactgtccatcctcatgttccaaatcatcaaggatactgtccaggtaagcgatcaaatcatcgtccggctgcccattcagctcaagcttcacgagacgttgtgtcccccctcttacaaggcccagataattgatcagctgggcatatgaccgcgcactgtaaacggatcggaaaataaaccctgccaggataaccattcccaaaaggaacccaaatgtggtgtaacgtacataattctttttcttttgtatgctcatatgctctcctcacaccgggcggaagcaatacccttttatttacatggtattccccgacatttttgaatcggtgcgttttcctatataaaagtacgcaaatgataacaggatgcctgtcacactgataataatgaccggcatcagctcaccggccgcatccacataggaagcggatgtcagaatcgtccatccgctgtctaatcccacattccggaatgcataacaggtcggcacaaacccgtccaggaaccaaatcgtaccgctgtcatcatttttgacgcgcagaagcacagattccagcctttccccgaaaatttttttgccttccagtgcggaatcattcacataacgcctcagtatattctgcatatcatccaaatccgtaatctgcctgtccatgagctcacttttgagcaaaatcaactgttccgtatacttgctcagatgatcggagacacgataggttatctgttccgaaaagcgttcaaaggcaagcaggccgcgttctgtggaattattcatgaagtaagtaaccgtgtaaaaaatgctggccgtaacagctgcaacataaagcagcagaagtaaaattgtacgccgctgtttcttatttatcggtttcaagcgttacctctcctttcacacggttttcaccggaattatatcctgttccccatctatttccacagcgcagtaccgtcataggcctgcattgccgcctcataatatccgagccgcctgcactcctcaattaccagacggtggatactctcaaatgctttcactgtcttttcgcagaattcctgcggttcctcatccataagcgcacggaacgccgccgcacactgttcatggatttcgcagttcacaggcgttttttcaacggtaagcagccccggaataccgcggccaatccggatatttctccgaaggagttcataaatcgcaccgaacgcttcgatcccgatatgctccgtgatgaaatccagaaggacagccggtgttcgtccatacagataatcttcattccacagacggtccgcttcggcttgtgccgcctgcagagcctgccggtcagcatgagcggcggcacaggcggcggctccttctatggtcagagtcagcagctccagcgtgtccagataacgtctgacatggagggccaccaaatgaggcggcatatggattttctgtatttcatcccgatccatttccacaaagattcctctgccgcggactgtctttacaacgcccaattcctgcagaagctgtatcgccttcattgttgtatccacactgacgccatacatttcctgaagctccctgtgctttggaagctgatctccgcgctggtaccggccggcggaaataagtcccacaatatccatatacacggcagaatatctggcctcagatacctgcagcagcttctcaagctgtgtcctgccgagaaggactgcggaatcggaagcgaccttaaaagcgggcgtgtctccgtctgccagtccatataagccggacatatcatcaaaccggacgctctccggttctccgcccgtttcaaggactctcataaactccttcatctgttcgtaatatctgatcctgagctgatcatcatcctgtaacggacttaattcagaaagccctaagccgtcaaccgcctgcagggtgagggaattttcattcctggccacaaaaaagcggtaaaacttttttgataatttccaaaattccgacggatttccaattttcatgttatccagaatccggtgcggaatctccagatccgcccggctgcagagcgaaattccgttcctgattaccggatagcacagcagaaccccggtcttaagcacatcgtttgtgacggatgcgtctattttctcaagggccagtatagtcgtcttattgccggctttccgtttgaagcttactaccggacgcttcctttgcgaggtttgaataaatccattttcctccagcatggccagtgcccggcggattgttttttccgaggtcccgtactcctgacataaatccgcacgggaaggaaggcttgtcccctccggcagaaggtcgctttctattttatttttaagaatctgaaaaaccctctcatacatcagcatatggaatgatcatcacctttcgtcagtcttgtttcttgttgtcaatttctattcagcatgccatataccttcttatttttcaacctgtttctgcaatactttcgtgtatgtttcaataatatcattcatgacaaagggctttccaatatgcgcattcatgccgctgtccagacacttctgcacatcctcattgaaggaattcgccgtcatggcaatgatgacggtacttttggcgtcctgacggggaagggcgcggatcgcctgcgctgcgctgcagccgtccatcaccggcatctgcacgtccatcagaatcagatgataaaagcctttcggagccccggagaactgtgcaacggcttcctgtccgttagaggccgtagttacgaaagctcctgcatcctgcagcaaagccacggcaatctccaggttgatatcattgtcctccaccaccataacctgcgcgcctgccagtactgtggacgtttcctgttccggctgtacacttttctgccctgtcagctccgccatgagttcagcaatgtcggaatgaaatacgggccggcaaagggtggcatcggctccgcataaggaagccgtatcattcagttcatcctgatcctgacccgtcaaaataatggcagggcgggtatcctttgcctccttccggatatctgaggcaaacagccgcatatccatggaaatattccatttgataaaacataattcataggggggaccgctttgtacggctgcccgtatcttatgcagtgcggcctcctcactggatacggaatccacctggaagttctcctttgccaacatatatgccagatgtttttccagttccgtgacctgatttaccaccaaaaccctctgtccgttcccgcagcgttccgtgtctcttcccacagcagccggtgcaaaaggcaaatcaaccgtaaaggtacttcccgcacccacttcgctggagacggaaatggagcctcccatcaattcagcaaagttctttgtgatgggaagtcccagcccggtacctccgtattgccggacgatcccgctgttttcctgtgtaaatgcctcaaaaacgctgtcaatattctcaggagcaatcccccttccggtatccctgacggagaaacggagccatatccaatactcatcacgccgcagctcctccacattcaggctgacacgcccctgcgcaggcgtaaactttaccgcattggaaagaagattggtcaatatctgattcaggcgaagcgcatcgcccaccagatattcttcaacctcaccgtggaggaaaacctgaaagtcaatctgcttgcttatcgcctgaacatgaaatacagtcgtcagggcacgcagaagccgtcccaggtcaaactgctccggatgcagctctatttttccgctttcaattttggacatgtccaggatatcattaatcagggatagcaggtgcgtggacgaaagagtgatcttatccagacagttacgcatgcgttccggttcggcaaggtgatttttcccgagttcaaccatccccatgatgccgttgagcggtgtacggatctcatgagacatttgggacaggaaattgcttttcgcccggtttgccgactccgcacgttccttttccatcagaagcagctctctgttgcgtttttcacgatggctcagcaataaaaagaaagctgacactgtagaaaacaggataataaaaatacccacgctcacagccaccataaactgactcagataaacaatttgatcgttcaccgtttcgtatgccatgctggtaactatataccagtccgtcccctgaatgggaacataatagaggtatacatgctgccctcccaccgtcatcagcgtcaatccgcttttaccggctgcaatcgccgcacggaaggactcataatcatagccctcgtcaaagtccgcctgttgttcatagatggtgaacagattagagccctgtaaaatctcttctgaaaaaccgctttttattacaaagtccccgttgcgggtcacaatattcgtataagaattggtgtccttctcactgtccagccccagcttcactccgatatccgatgtatggataccaacgataacggcaattaaccggctgtcctgaaaggatacgggagtcattgcggttcccagcaggatcgtattgctttcccaaatgctttcatttaccgaaatcagcttttccgaaccatccagcaatttatccaaattggaaatctttgataatgcgggaactgtgccatccggagaataagctattcctttgctgcttattaaggcaatatgtgtaaaatcattatcctcctgtgcctgtgccagaaaatgcttcagactttcttcatccttcaaatcattttccgaaattgcgttggaaatagtataaatctgtgaaaactggctgttcagatttgtctgaaaatgactgctgatctgtgtggtcatttcctgcaggtaaaccccgctgatatttgtcactgtacgcgccgacaccttccggtatataaccgccgcagatatgcaaaggatggcggttatcagaaacaggatggaaacaaaaatcagcctcttgtattttctattccattttttgtgaatattcaatgctgccctgtcctttctgcgcctgctatttatttcccctgtgccagatcagtgattcttccttccagctgaacatccacggccgtgtccctatgctgctcaaaataaagcgccagggcatcgcggtaaagcagcccggtttcctttatcagtgtcacactgcccttcgggacagaatcatcatagaaattcagcattgtatatccgtccccatttccctccgcataagatctggctccggccatatagtccgtcaccgccacctggtagcttccattcctgtccaaagccttcccatccggcaaggtcacactcacaagcctgtttcccgccggtttgctgctgtcaaaaatataattcaatcccgagacctgtaaaaaccgtccgccggggaattcttctgtacaggtagacaggccgttttccaacatatcccacaaggtttgtccgtccatttccagtacgatgatctggctatcaaaagggcacaccacggcgatatccccgccgtacactactccctgataaaaactggcccggatccctcctccattgaccaccgcaatcggggcgccggacgcttcggcaacgcagtccgctataaaattaccaagctctgtttccatgaaccgaacattgaaattttccagcagcagatcccggcttaccgttccaatctccgaaaagtcataggaggattcatccgttccctcacaataaaaccggtctatggcctgtaaagcctcttctaccgtgcatttttcattcataacctttctcacgtagccgccaagatattccactgttttgctggggaacaaaacgttataaatatatccggattccacatattcctccacgccgtcaggtatcaaatcttccctctgccggtaatcggtgagacaggacattccggtccccatatcctccattaaagcctcctgtccttcaggtgtggaaagcaattccagaatacgcctgcaggcgttttgtttttcctcgcttatcgcattattcacacccagaagggctgaaggggaaaacagaaaccagggttcatttccttcatcgctcagaagcggaagcatccggtaggtataggcctctgccgtaccttcctcagccgccttccgattgtctgccgcacactcataatacagtgccgaatcgccaaaagccgcagcaagggtacctttgacaagacgctggtgacagaggacggaattacgctggaaggaaatcgctgcgggatccatgacccccgcttccaccagggcatccgacagtgcaaagctcttttcccaaacgccggtaaaggccgcctttttatctgtaaaatctgccagccacttcataccctcaaccgttcccagaaaatcaggcaccatatatccaacgtaaaacatccccacggatgtattatagtcactcttaatagcaaaattgaagtcgtcttctcccaggccgagccctttttcctttaatccggccagagcggacactaattccgtattatttgcgggcattgccagtcctgcccgctcaaataatgtttcattgacgatatatccgctgtatacaccgggcagcgggagcagataggttttcccttccagcttcagcgcattcatgatcgtgccgtcatatgctgcgctggcttttgtgtcactgatatccagcaaatacttcttcaccagattggaatctggctgcggtgagattaccagatccgggcccacgcctctgtccagacggcggagctgttcactggagtagggggaaatttctatttgcaggtcaatgtcatcgtaaaccgattccaccagttcctctacctgcttaaagttattggagtaaagaatcctgatcacgactttttcttccggcttctgccggccacagcccgacaagaccgacagcagcagaacgacggctaccattcccataattctccgggctgcactgcgaatcataccgtatcctcctccttttcttcctctgactgccggaaatgggacgataaaatcgtcttcatggaatcatcataaatacgccactggtttcttccggcctgtttgcaggcatataacgcctggtcggcacatataaacagttcttcatacgtgacgccgttttccggcgccagagcaatccctatgctcgccgaaacctcaaatccctcataagcgccggataccatgtgaaaaatacgatccgccagcttttgaatgcagcctttgtattccacatacagaaggaattcatcaccgcctatgcgcgccacgatatccgaattacggacgcttcttttcaatcgtcccgcgaaggccttcagcattttatccccgtaaaaatgaccatagctgtcattcacatttttaaatgtatccatgtccaggaccatcagggccgcttttgtatttcccaaatcggaaagccgcagcacgatctcttcatacgcgcggtttctgctcagcagctcggtcaggtcgtcatgctgggcctgcacgatgagctcatccagcgttttctgctcttcctcattatccacaaatttaccgatgatcttcgtgggaggagcctcctcatccagtccccagagaggacgcgccaccgccttataccatcgcggttccccatggagcgtcaggcgatagcgacggctgacaaccgggttctgcggcgtagccttctgcaggcgctcgcgaagatcacaaaagtcttcccctgaaaaaatccggagcagggaggaatcactctgcggatgctgtatactctcgttaactcctgcatgggcagcgccccattccgacaggatgagtgtatcggagccataattatattcaaactggatttcttttgtcatggaagcataaaactggtacttggtacgctcctgctccagcagatccaacgttctgtcggaaacattaatactgtggagcgtgtcatgcaccagcgtatggatggaatcattgcttattttccccgccgaacggatcttcacctcgctttccagataatcccccacttccttcaggcagtcaagcaataaagggttaaaagcgccgcattccccattcaaaatcatttccatggcacgtttatgcggataggccggcttatatacacgcctggtggttaaagcatcatagacatccgccatggccacaacctgtgccgaaacaggaatttcttcgccttttaatccgtccggatagccgcacccgtcatatcgctcgtggtgccaccggcaaatttccctcgccacctgaaccagctcttcgtcctgataatatgtaaggccttccagcatctgcgcgcctacctcactgtgcgttttgatgatttcgaactcttctttatccagtttccccggcttattcagaatgtcttcgggaattgaaatttttccgatatcatgcaggctggaggcattggtgatcagggctatccgggccggggttaaatcatattggccgcatacgctgctcagctgcctgagcagcacttcggttatcgttcggatatggagtacatggaggccgctctcaccattacggaattccacgatatggctgaggatatccaccatgaccatattgcttttttctttttcatatatctgctcacttacaatattctccaaatgcttttgtttggcatggagctttaccgtattctcgatgcgatgccgtatggccaccttgtaaaacggacggttgatatattccgaagcgcccaggtggtacgcatgctcgatataagacggtgcattttccgatgaaacaataataaccggaatgctgtttatccagccattccggttcatgacagccaatacctcgaaaccatccgccttgggcatcacaatgtccagtataacaagattgatttcagagctgtgctgcttcagacattccacgacctcttctccgttggacgcttccaggacttcataatccggggacaaaatatcagacagcattgcccggttgatttcggaatcatctgcaatcaaaatcttttccttcgtgttcattgggcattgcctcccgccagcacagacaattgtgaaaaaacagccgccatattttcgtattcctgtttgaattccgaaaatgccggcccgatatttatattctcctccctgttacggagggtttctgtcaaagcacctgccttttcagccaaaggagtaagacccagattaagagcgatgcccttcagtgtatgggcgcctctgtaagcgccttcatagtcacaatgttccaaagccgtacagatgtcagcatagttggaatccttcagcagcatactgatcagccgcggaagcaatttttcattgatccggtaactcatctcctcataatttccgcccaattctccataagcctcctggatcgtcatagtcgtactcctttcaaagcagattcttggatccttacccaaataattatagagtatggactttacttttgcaacagaaatgttaaaatgattgtcaatcccctttactttccttattttccggcattatcggatgcacgaaaaaatcattggactaatcggcaataacgttgtaatatataaacacacaacacatatgtactgtatataatatatacacagactcaataaagttcgtgccgttttcgattttcttccggaaatgcagatccggcaggttttcagcggtaatatcctttcaatccaggttccttaaaggtgaaaagttatgaaaaacagagttaaaaaacaagccgtaaaaagtgcagaagcactgtcctattcaaaagtgcgcagagcttttattatctgcctttttctgggcattttatgctttttgcttcaaaacgcatttcttgcctatacggatatgaagcaaaccgtaaagaacatacagcagagtgtttccgcccaaatttcggaaaaagtaaatgaatctctgaagctgctggaatcccttgcatcacttgagcttttttatgaaccggatactccctgggaagaaaaagttgcagtgctggataacataaatgaattttatggatatatgtttatttgttttgtcgatcaggatatcgttgtatataccctgggcgaggaaccggcaagcctggcaagccgtgaacatatgcaaaaggtttacgcttccaagcagccctatgttacagacagcttcgtagccggagccgacggcaaaaccctgaattataccgtcatcgtcccgctgctcaaagacggcgtcatgacgggcagcctgtttgccacagtcgttttggatgatatctccggtcttttaaacgaaattacatccaccacaccagcggaagcggttttgatcagttcaaaagggctggtcatgtgttccacaaacaatttgacctatggaacatctatccttgatatcctgagcaattacaagttgttgaatatgactgccaatcagttagaggaacagatgctgaacagacatttcggttcgttccaaagctataacggcttcggacttacctatacggaatacggcccggtggagaattccaactgggatgttttggtgaccgtcaaattctggccggtattcctttccatgctgccatccgcgggttttgctgttttgggaatgcttttgatcatggcggtactgtattatttcgtaaaccgccatgccaggctgcagtcccaaaccatagagaacatggtcaaatctgtgcagcagattaaaagaaaagtctatcagggcaatgacccttcagaacaaattgattatgaaaatattatccagctgtccagcaagggattaaatgatgacctgacaggaaccttcacccgggttattttcctcgaccgggcggaagcgatgctgaaggataaacaggatgatcatatattggctctctgttttattgatctggataatctgaaaatactgaacgatacgaacggccactcggccggtgacattgccctgaaaaaaataggcagcattctgcgggaatatggtgcgaaatatgacgggattgcgggtcgttacggcggcgatgaattcattttgattttacgggatatcgataactctgatgagctgcataccgtcctcaaagagttggttgacagattgaaatttattatatactgcgaagataaggagattgaaatccattgcagtatcggcgcaagcatatggcataaggggcttaccctggagacgctgatttccaatgcggacaaggccctgtacaatgtaaaatgtcacgggaaggctaattattcactttttttgaatggtgggcacgatgaaatataagataaagcagggcatgattttcggtatactgtttcttatcctggcaggcgcaatgcttattctggctgaagcctttaaaaacgtcattaccgccgagcgtatggcggcggcccggacggtagaagcaggctttaacagaggccttgatgaaaccttcgggaacttaaaccatgcggtgaaattatcctatgccattgatttcgaggataccggcagcctgacgctttttcataaaaaggtgcaggatcttatggatgaaaatgaacatatttcctatgttgcctactttaaagaagatacactggattacatttatccggcagataaattccgttctttaatcggaaaaaacatggctgactttacatacagcatcactttggcaaaagtcgttaaaacgcctgttgtggaaggtcccgcaaatctgctcgacgaaaacggcgatgtattcctttttatacagccgctctataacggcacatattttattggggaaattgtagttgccatggacagcggctatgtactctcctctttgggcctgaatgagttagagaacggcaattatgactatgaactctggcgtgtggattttctcggacacagcaagacagtcatagccacttcagataccacggtagattattccgacgccgtcaaacatgaattcagccttcccgccacatggaatatcagtattttaccaaaaggcggctggattacaccctccgaagatgtttttattaataccgtattcctttcctttggactcgtcctgctgggtatattgattttactgtaccgtatcctccggctgcagaagaaattacagattgccaaatatacaaatgcagacagcgggctctttaccatggaaggctttctgctctttacgaataaccgtttaactaaaaatcccgattcccatctgtgcatcctggagctgcagctgggaaatttccgcaggtttacaaaaaatatggatcgggaggaactcgtaacgtatttaatgcagttaaggcagaatataacggattgcttccctgatgacacagtcgcggcaagaatcaatgacgatagttttattctcgcaatttttatggacggccagcaattggaacggtccattgaagattttatcctgcagctgtattggaaaaggaaaattgatgatcagaaaatcttcatcactccgcgttaccgcacggttacatacccgaaagacggcagggatgcgctgtctcttgtaaaagcggtaatcaggcagtttgaaacaaagcctgaaaaataaagtaccagaaaaaggcataagtgattttccagtcacttatgcccttcctctatctattcctcggtctccgcttcagcctcttcccgataatacagccgtacggcagatacattccggcggaaagtatggaaattggcccatgccgtcgggcctgcttcaaagaattcccgtgccgcgtccatcactgcgggtaaatcccatgcgatgaaatccagatagccgcagtacaggccgctggctccgcccaggaaggtgaccgcgtcctctcccgctttttccagcaccgcttcttccagggcatcccggaaatccagcatatttttcgcccgctcttcgcctgtaaagtcatctgtaggatagcagaaaaagccaggcaccgcgccgtccttatgaaaagcatccatcacactgctttcattgttcaggtactcattcagaagcgggatacagcgggtagccccggcaaacacatccagacgccagtctgattccggatcatcactgggctccagttcataggcggagtagcagttttccagataactgtccgcatctttgtaaacagttatccccatattttccatttcccggggtaaatctgtcagtattatggattgttcttccttaggctctttcaaaacttcaaaaccataaatatgggcgattgcggggatttcacccagaacctgatcggtaagggtatacagcatccaccatgccatctcctctttctctttaagcagcggaagcagcttttcacaatacagggccaggctgacattctgctcgtccttcttttccgcccatacctgtacctcatcatccgatacttcccatccgtcacggtgcaggccgaaaccatggccgggctgacggcctacccagatgttccagtattccaaaacaggctccggcacatgacaccggaaataaaccagttcgaacagcttggccctatctccctcgggggttagtattaactcatattttgtcccgttaaagcccagttcaaaagcgatatccttaaaagcaagatgcaggatgtcaccgcattttttgagaattcggtttcctccctgctcctgatccttctgatccatcaggctgcgcagctctgcctcttcctttacaaaggcggcccaggcctcctccgtcctttcccgaaagcttttgtcaaaatggggacaggccaggcagctgcggcatgccttgatcatctccatagtatcctcatcaccgggcctggcttccagtgcattctcaaaataatgcagggccagctcctcctgatccaggtaataataagcgtaggctatccggaaattccagcagtgatctccctcaaaatattcctcatgaggttttagcagactgacggacttttcaaaatattccttgtcctccacatcggccgcattattataagcacgggccagttcactggcaagctccggagtgagttccgattccgggatagcttcaatcgcgtctataatcttctggtattcatcattttcgttccaaatccggcattgttccaataaatccatatggatttcctccttacattttcagactccggcctctcgtcaaatcgaagtgtacaatcttgtaaaactatcttctcacatttgcttgccatgagtcaacctctttcatggaggatccgcatacttctgccgcatgccccgcagtaagtcgtcatcactaatttaccggtatgccgttcagcgcattcagcaattcttccgaaaactcttttgatttgtcaatgaaaggaatatgtcccgtattccttatagtgataaattccttatcaggagaagaaatattgttaaaataatcaagcgccatgctatacggcgttgtccaatcacaatccccggcgataattacgacagggatttcatactgtaaactgtaatcgtaaacagatgaattgttttcagacagaagccccttataaatttcgctgttcgattcaataagactgtcaaagctgagcatccatttccattcactcagagtcatatatggagagaatatctgaagggctcccattttatccccgtattgtgacggcagatatttttccttcagctgccggaatttcatcaattccattgcattctgtttatctaatttttggaaggacataaccgagtcaagtgcatcgccgatatcctgggcatcctgtgttttacccgctgtatttgccagacggatggcctcttgtgcggacacctgttccgacagcttaaaatccaccatctggcctacagctatatacgcggataccttttcagggtgttttcccgaataaaccccacccaaaaacgtcccccatgaatggcccattaaaataaccttttctttaccatattccaaacggatatactctgttaattcatccaaatcggaaagcaataaatccagagtgggcttttccgcatgcttgttccggtaataagtattgccgcagccgcgctgatcccattggactattgtataagccttctctaaatctgcctgccagccatatgaataatatgccatattgctgcccggccctccgtgcagcataaggataaccggattagaaatatcctgtccccggatttgtatatactgctctatgcctcctatggttatgtattcggatttttgaacacctgcttccgagctgattctatattttcttgcattgacaatttttccgatggctattatcagcaccagtaaaaacagcagtccaataaacaggaacagtattattttcattgttttcctcactattttcaatcctccagcacctctaatatcttttcaatgaactgttgctgctgccggataattgcgaacatattttctatagtgattcttgaaatctgaggaacctccctacctgctgcctcattcgttttttctcccttttcaagagcacagaattcttcatccaggagtcttttttgttcctccagcgcctgcctggcattctctcgcggaattttatcgagaagagagagcccgctgtaaagtgatgtagggtatattaccgaagactcgcgtaatgcatcaaatatgatggattgtaaataatccttccccctgtccgtaattttatatacggctttttgtctgtgtcctgtttgctcaatacctgacaattcaatatacttttcctgttccagctttttcagtgcgtgatatatggaaccgaccagcacgcctccccatctctcagcatctgccccgattattttttgctgaatatcatagccggacatcggctgttcatccagcaggccaagcacaagaagtcttgtcattataaaccacctccatacgctatactcaacattgagtatacaacatgaagtgctttttagcaagcctggtttattctgctgtttatgttgctcattatatcgggatttattttttataacaggataaattactgcttctgaaaagagatcaccgcaccgccgcttcccaatgctgccgaaagcccttccggattctccacccttccaagccttgtataactgtaaccggttgaaaagctgtcataaaacagcacaagacaattcgctccataaagcataaaatccccgttctgtatgtctcccacaggttccgccattgccggtaaaccgctgtccagataaaaatatttctcatttccgttcagctcactcatatccaatgtaagcggaagcaaatccgcaaaagcggccgcagcatcgttatcatacaggattagcgtaaagttttcgttacctatctgcacatttactctgtctgtattccttatttccgtttcctctctgtttctgctttccttcagttctgtcgtttccatagctgaaagattttcaccgccgtcactttcccttcgccctccggcagcctccgtccccgacggttttgccgattccgctgccgtacttcgggtctcgtccggaaccagggactcgtccgcagccggggcttcattcgcgccgagatccgcagcgccgcttcctaccggggaagaggtactgctggcagacaaaaacaggagaaacgcgcacacaactgttatcacttttctcatcctatttcccgtttctttccatatatacgctttatcagcattgttttacagcccagctctcatacgctgccacaccttttttcagccggctaagcccctcggtgagccgttccctgggacaggcaagattcatgcgcaggaaccgtattccgtttcctctgtatgaaattccggcagaaagataaagccccgtctcccggcgcagaaactgccccagttccgccgcatctcccagcactcccgtacagtccagccacagcaggtaggttgcctttgaatccaccgattttacctgcggcagttccttctgtaaaaaggctgctgcgtaccttctgttttcagccagatattcccgcagggcatccagccattcctccccttctccaaaggcggcagccacactgtccacggcaaaggaattcggttccgcaatttcatccgcatttaacccccggagcataatattccggatcctctcatccggtattaccacagcggccgtctgcagtcctgccatattaaaggctttcgtcgcggaaatgcaggtaatgctgctgtcccggcagctttcggagacagcggcaaaggggacataatcgctgccgggtaccgtcaggtcacaatggatttcatccgccagcactgtcacatgatatctgcggcagagttcaccgatacgctccaaatcctgcctgctccatatattccccgtagggttatgcggattgcagagtatcatcattgtcgtgagaggatcggccagcttctgttccaaatcagcaaaattgatgctgtattctcctccttcatacttcagcctgttttccagtacatggcggccatggttttcaatggaatggaaaaaaatatcataaaccggcgtctgcaccaccacgttatccccaacattcgtcatccgttttacggcacaggtcaccgccgggacaacgccggtacagaaaataagccattccttctgcatccggaagccatgccttctgttccaccagcttataatcgactgataccattcctccgtcactatggaatagccaaatataccgttctgtaatttatgctgaagtgcatccagcacagccggagccgtctgaaaatccatatcggctacccacatgggaagctctgcctctgcggcatcccatttcagggagcctgtatttcttcggtcagtaatccggtcaaaatcaaactgcatctctatccctccttgtctgttttttcgttcataactttttttagtatgaataaacatccgccgcttcatacatagagcagaagccccggcatgacgattacgcgcatacacatccttcgaattttccatctttttgacagataattcttgtttttcccggatccaccttatccttttctattatcagttcccctatctcatccgttcgtatggtccctcccgagggattaagcacactgtctatctttccctggatttgcgcgtccactgtggaatattcaaaagccagcgcagtatgaatcagcctgcagtttttcatgacaagattctctatataacacattccctgcaggctttctatggtacagttaatcaaggtcagattctttgcgttccagcccagatattcccctgaaataaaggaatcatataccgtcacattttcactgttccagaaagcgtccttggaaagcatttttgcattgtggatctctgcgtttttcaccccgtcaaaggaataatttccaaccagcgtaaaatcatgaagctccatatcccggctgttcatcgcgaaataatcccctttcgcggtaacctgctccatcacaaccccttcacagttccacagcgtttcagccgcattgggcaaatccaccttctgcagcaccaaaccatgacacctgcggaaattcttcggtgcttcgataaccgcatttttcaccgtgatattgtccgtataccatactcccgcacgcgccatttcaagccaggtacaattttccgccagaatatttttgctgtaccacagcggatatttccactgaaacatgctgccgaaaagttcaatatcatgactttccttcagcggcgattccccgtccgcaaaaatagtatcataaattttcagattatttccctggaaaagcgcacgttcacctgttaaatattcctgtctgatttctttcatgttttcttttccttctttccttataatttttcagagacaatgtgtaagcagccgataaagcaagagcagttagaaatattctaacctgcgtaaataatatgcttctgatataaaagcaagcactgtctgaacgaatttcggtgcagctttaactgtttttatcatagcaggcacgcatatagatagcaaatacttatatttaatgtatttatatagttatttcctatttatatatcaaatacatagaaatttggttaattgaaatccttactgcaacattgaaattgtaactgcacattgacatgttttttgaaattgtaactgcatgctgtatagggtaactgcaacactttccagcctattttgctgttttcattgcctttttttcgtttcttgtgtacaatagctgaaaaggacggcatcacaaaagccggactgctttcttcttcttttttgaagttgtaaatgcaccccgctctgacaggtttctttttgatagttctcctgtcctgccttccctgaaatcccggcttacctagtaaacagggccggtgttagtgtaatggatgcggatgggattttctcaaggccaaggagagttgcggtctcctcgccgtagatctttttaaaaagatcaatgggagcctgtccgttccatttttttcgtggatatgaattgatgtggttcatcatttccctgatctcttcctccgcatagcggtcccttgcctggcctttcgggatgacatatcggatgaattcgtggttccgttcgcagttgcttttctggttgctgttcatcggctcacagtaaaatacgcggcactggatctccccggtttctgtgtctgcctcaatcctggtggggtctgtaaactcactccccctgtctgtcagaattacctgaaacagagcctggaagcgctctccccccaactgcacacggagcttcttaattatctccgtcacggacgctgccgtattcctatcccgcagaaacatcagctgcaggtcacaggttgtgaacaggaccgtcaggatggcctggccccctttatggatgactacgctgtccatctggctgaccatggcatccgggttctgggccatgtacgcctggtaatctccataagcccgccccatatggcactttttatccacccggaggaccggcccgctcttcttccgctccggtcttcgcagtttcctccgcaggtctatgttccttgcgtccagaatccctgcatctatgtaggaatagattgtgcggtccgttactggcagttcatccctgtacatcccgcagatagccggtattgactgcccctgcttgatcagcggtgagatggtgtcattgatccggaccagttcctcttccgtaagagaaatacccctccgggactctgaccgtatcttctcatactgctcctgtgcatgctttgcatcatagagcatccttctgaggcggcagcggagccggttcccgcaggcattgcagacaaacggggatttctcgtacccactgcagaattcctcctggtactccgggcagtccgaattgcagccaccacacgccgtctggcactgacgtttcccacggaagcagccctgccggcattccggaaccttcgtgcatgtatcatggcggacacagctgttgcctttcgaggtggctaccagtttccggtgtgctttgatctcacggcctacagtcgcgcgatccttgccaatattttttgcaatctgcgcaaccttcagccctgctgtaaccctgcctggattgccagcctgtcatcaaatgtaaggtgtttgttgttcatgtactcctccaatctgaaggcaggacatgaagcattataccctaatgatatccagaccacaaagctatgaggtcattactgcaactctctggctttcgcagcaggtaattctaactgcaacagcctgtgttgcaattaacttttcaacctaccacatagaaatttccactcttatttccttttctcataatataaaaaagaggatgttccaaaagcagcgatttacctatccgcccgcttcggaacatcctctttatgaaacactatatcatcggaacagagccattctccgtcccatcatccactcacatacactgctgtcattgaaaattcctgtcaataaaatctatgtaaggctttttcctgacttcctctttattgcttttataccattcataggattccttcaagccacagtataaatccttctgctccggcataatttcattctgcagcgacacatccagaagatattcataattgtggaagctgaaataatcacgctgattaggatgatccttaacaaacactttttccaaaggcgcacctgcagcccgataacacaattctgcaaaggtgctgatggagacaggctgtgtattgccgacattgaagatatggttatccggatgctctcttaaaatgatgtaaatgaatctgcacaaatcctcaacatggaaaaacagcagtttcatttctccgtctccgggaatataaaacttacgttttaaatcggcacactcaaacacgaagggttcacgatacaaattctgcatagggccatataaatatggcggccttatcacatatgcattggggtatcttgaagtaaggcagacttctgcacccaccttgccggagctgtaatccccccagatgctgttttttcctattggctgccgttcattaaatggctggggcagtgtttctggataaacggcggatgaactgattaatacataatcatcaaactttattcccgcattaagcagattgttaatatcggcttccttatatgcgcagacatcaatcacggcatcaaaatacattccgttcaaggcgctgccaagcgaatttctgtctgcttttattaaattaacgccttccgcctgcggccttgtccctctgttcaatacatatacctcatgtcccctgcctgcgaaatatgctgccgtaaatttactgacaaataccgttcctccggtgatgagtaatttcattttattttgcgccttcctgttataataatcccctgccgggtgtaacagtgcaattttatcatatccctgccgggctttccatgtaaaaatacagattcctatctgccgcctcaacagttctccccttctcttcatccgcatttcccgaataaaacggataatttataaatgcatcccggcattatctatggtaaactgattttatccataaaaatgccgaaggctgcagcgcttctttctccggtccgggtatggcgcgctaaacatgcagtacaataaggagagaacaaatggaattacgggtacttcagtattttcttgcaattgcaagggaacaaagcattatacgggctgccgaatccctgcatctgtcccagcccacactttccacacagataaaaaacctggaggaagagctgggtaagcagcttctgatccggggcacaaagggttcccggaaagtgaccctgaccgaggaaggcatgatattaagaaaacgggcagaggaaattttagatttggtaaaaaagacggaaaaagaagtaacccttaccaatgatatcgtcatgggagatatctatatcggaaccggtgaaaccgacagcatacgtcttatcgcacgggccgctaaaaagctgcaggaagcctgtcccggaatccgttaccatatatccagcggaaacgccccttttgttttggagcagctggacaaaggcctgcttgatttcggcattgtattcggaacagtagaccttgttaaatataatgccctgaaaatgcctgcagcagacctgtggggcgtgctgatgcggaaggattctcctcttgcctcaaaagaaacaatcgggccggaagatttatgggaagaacctctgatcctgtcacagcaggaagaacgcggaggccagttaacacagtggctgaactgtgaggcatcggcgctgaacatagccgcaacctacaatctcattttcaatgcatccctgctggttgaagaaggcctgggatatgccatcgggcttgacgggataatcaacaccaccggaagcagcactctctgtttcaggcccttagccccaaaactggagaatgaaatgagcatcatttggaaaaagtaccagctgttttccaaacctgccggaaaatttatagatgtcctgaagcaatatctggaggccccggcggaatgagttaattttcatagcggaatcccgtttcctcatattccgtttccggaggttttccgttttttccgattctcctgtacagcagtattccgaacggaatggagatcgcttccgctatggcaaatgacagccataccaaatgaagctgtttcagccatgcccccagcaagagcagaggggccaaaaggattgcctgtctcgaaaatgcaagatacatgctgtagcttccgtttccgaagccctggaacaccgctgcgaatattatgccgatggttccaatataaaagctcagagacatgaaccggactgccggaatcccgatccgcagcatctgttccgacgcatcaaacagcagaagtatcttatccggtatcagctccatcaataccagaacggctgacataattataaatgcatacaggaacgcacattttatggtttcccgaatccgcccttcctttttcgcgccatagttatatgcaataatcggtatcaatgcattattcattccatgaacagcgatctgcgctatattctgcaccttcatgagaattccgtaaacagcaacggccgtcgatgagaactgatacaatatggtattaataaaaattcccatgacggacatgattccctgcataatagccgttggtattcccactttcaggatattcaccacatatttgcctgaaatatgtatcgtaaaatgtatgggtatttccttattcctctttatattcagccagattcccagaagccctcctgcaatctgtcccgtaaccgttgctatggcggcccctgcggtacccagggcaggaaaaccgaaatacccgaatatcagtatcggatccagaatcagattcactatggatgcggttccaagcgtcgcaagaaaaagtgttgactttcctgtggcaatgagcagccggtcaaaaacccactgtatcatctgaccaaaggaaaagagcatacatatccggatataaacactgccgtactcagcaattgtctcatttccgcccgcctgccatgcaaaatacggccttgccgccagcaggcagacagctgcattaatcagatacgccccaaaagccataacaatggctgctgatgttgtcttttttacttcttcctgtttcttttcgcccagagcctttgataccattgcattcaggcctacggcaagcccgcagcccaaagcaatcataatcatctgtaaaggtgcggcaagcgctattcccgtcagcgcctcttcactgaccctggaaacaaagatactgtccacaaggttataaagattattcaccaataaggatataatcaggggaatagatgtcttaatgattaattgcggaatgggcatagtacccatcagattttcctgctgcatgttctacctctgctttttatttcaggacactttatacgattccattaacaattccgtcggtgagcagggaatacaggataataaacagtaaatgcaatcggctgcccttttccttttttaatttaacatggttcattactagcagcaaattcttatatttaatatatatccataacttttttctattgaaatttccggtatcagcaagagctttttccacctgtaatacattgtaattttacattgcctgccgccaatgcaccgcctctctttattccgcagtaatatccagtccaagactatttacccattctataatttcctcacgggaactgctgccggaaaactgttatcttttgataatcctgtaactctggaaagttcagatacggatacacttcatgattcttcggataacttttctttttataaaagaaaacaggtatttcatatactcctggaacatctttcgattatcttcttgtcaaatatctaaaaaaataaattgggggcatttaaatcagattttcctatctgtctttttaacagtgatgaaaaatcctcttcttgatcctcctccatttttagaatattctgaagttctgaattctccgcataacaaaaccaggtactttaatggaaacaagtacctggttcatctttcttctctgtttttcactgattttgcatctttagcgttcaacccatttccacattttctgctcattaatgtactctatcatgtctttataactctcgatcactgacaatatttatcttctaaagtgccatttaaagttccatctggcactttaagcgacatattaaagtaagcttttcaccatattcttaaataccaatatttactcatcttcttctaataaaggcatattaatcaattcctgcaatttattctgcaatacattcttatccggcaattggagttgatactctgcaaccatcattggagacaatgttctgctcatagcatactcaaccacttcatcatctttagatgcacataatatcattccgacactcggattctcattttcctttttcttctgtcgatcaagcgcttccagataaaaatccattttcgatatatattctggcttaaatttcccaattttcaattcaaacgccacaagacactgtaatccccgatgaaagaacagcagatcgatcttataatcttcaccgccaacctgaactcggaattcttcatcaatgaacgtaaaatacatcatctgcataagtttcataaaattttttcatacgatagagaccacgcctgttaaatcctttaattccaggaaaagcattttgaacctcttctgcgactgtatctatataagcatccccaaatgatactttcgtggattctgtactcaggtattctcccactttccaatacatctgaatcaactcttcattaacttttttcagcgcattctgccttgattgaataataatctggatgagattacctgctgctgagatttcattttttatcaaaatctaccacctttcaaatttgtgtcaacactgttgtcacaaatcatacaaagtcaaaacatatccacttaatcctatttgttctatatccctgctgataacaccccatagagccatgctttaaaagcatattttcaatcacaaacggagacatgggaaaatattttgttatatatcttctgtcattctgttgaatacctgcggcataagtattcactccaaaaagagtgtactccaactgatatcatgtataagccaatcaactgtcataagactctcctatttgaaaacaaagcattgcgtatttagttcacttaaattgtattataacgtatatttttaaaattatctattactattgctcaaaaaagcatgattcgtccccgactcatacctattcctaaaaaatatattcaactctttctattctaaccaccacttgaaacacagttaattcaactatctcattgacatattttcgccgttatgatatttttcaaattagcagcaatatgcaaaggagataccatgtataaacaacttatttttgagaatgaagtattgactgcatacacccatcacctcatggctccggaacacgtccacgtaaactgtgagtttgttctggtcactaacggcacagcgctcaatacggtagacggtgtttatccgctggcctcttatttgtataccgtggttgtgaaaagagatttaagtctgctgagtatcgatgagataaagctgctgtctgttgtggatgacaggactatccgctgtgcgcagatatttatttcactcacatgaaaagggaaaaatcattatcaaatccggcatggaaacctttgaaaactggacggccatccggattgtacaaaaaatacagtgcgttccctggattataacgttttttaatcttttgaccaacaatccatcaataaatgattcgcctacaaagtaaaaactcaaaaattcctttgactgcaatgttatacggcactctaattccatgttgagttcattcagatggacggtatcctccgttccgataatcgcagacagaatacggttccgaattaatttctttttctctttctttattcttcaatccttatatctcgggatattctacattaatatttttataatgataggtaattatttcaatagaataagtttcttctggcaatgtattattgggtaaaatattttcatcactaatttctgtctcatccttggggttatccactacagttttttgcgcatcctgataaagcggcaataactgctatgagcatacagcagcacttacttaaacgcatctcgtttccttccttctttttaagaatgtttggcataaacacccgtttggataaaaggtgtaatctctccacaataaatatagaggatttacaaataattttgagtaaataaatatatccaaccatttatttaatatattcttattcaacttttcaattattcatacaatgggaacgaacattccatcacctgattaaaatattctcgtccatattcttctacggtaaatggcttataatatctgccaccatttaaatcgacatagcagtagtattgttccccctcaaccgtgtatgacattatcgtatcaatagaatccttgtaaaagtttcggatataaatatcctctctgttggatgtttggccttccattctttccctattcaacatatccgaaatacattttttagcttcctttatatcttcttcgtccgcatcataaagcggtttacgccttgccccaatactaaccgttcccctccccgttacttccggtatataagctgcttttagaccatccaaatcctgctgaccaataaatgcatatctattatccggaattataagcctgccatcaaatatattaagttccattacatgatataaatgtgaaagactattatctggtccaatcagtggaagaatatagattgtgtccggataacggatatgctctcgcttttcagaataataatactcatattcaatatcctgattcatataaggataaaacttagaattttcattttcaaaccatatatcatcctctattacgattttaattacccgatttaaattttcctctgttatagaatatttttcagcaatgaaatgtacgtcctttttttctttctctgctattactaattcttcctcctgctttgtttccactgctattctttctgccatccggaacttcttacctccatcacaatcattggaggagcatgcgcatacactgcataaaacaaatataaaggaaacaatagaacttcttacttttttcaaaaatcttacatcctcctttataagacaactactccttttttacataattaaaaaatttatttcctccaaaattttttattttcagtattgtatttctttatcagtataatactattattcctcatcagcatatttgtaagaatcataccgccctttttccctatcataactccatacccgattataggtccacgggagtactatagaataatatccatctacacgttcgtttaagacagctatctcagcatgcttatgagggtcctctataaaaatttctgctgtaacactaagtctttcaacaaattctccattttcttcaacatacatacggattaaatttcctcctgaaccggaccacagaattccatgaaaacaaacaagataatcgtccaccccatctccattaaaatcaaatacaaagtaatcatgatcctcttccgggatttcaggaagtttgcttctcatatatttctcgtagtccaaatcatcctttactaaacttaaaactacagagttttcaaatattgattgaggattggtacaaatgttttctacatataccccataattttcttcaaggaaatcataatctattggtatagaaagatttcccttatctattttcccaacattttcttcttgctcttcttgctctgtttctttctgttcagaaattaccatattttgattattcatagaactattactatccttaactatatctttggtattttcagtattcagacaattatatcctgtaattaaaagaatgaggataatgcttgtaattctagctttgtttctttcaatcattctatttctccccataatatgctcaaatcaagcaatacccttctcattgctttagcaggtgctactcatacaacggaaagcattctttcagcatacggttataatattccttctgcgcttcctctacagcatttggagtagtatttcttctgccatccagatagatatctatatagtattgttctcctttgtatgtataaagcattactgtatctatggagtccttgtaaaaatttttgatataaatttcatcatcattatccggagcctcttgcatccatgaacctatctttctttccttctccaattctttccgaatattttcctttgcctcttcaatatcagcttcatccgcatcataaggcggttcgcgcctttctccgatactaaccgttcctctccctaatatttccggcatattatgttcggctttcaactcatccagattttctccactataataagaaatatgatttaatatattatcatcaatcctgaatcccaatatataataaagtgattggctatccggtttaatcaacggaagaactctaatatagccatgttcttccctataataatattcgtaataatattcgtattgaacgtcctgattgatataaggataaaatatagatctctcatatccaaaccatatatcatcttctattgcagtcttaagagtctgctctgttttttcttcaatcatcctttttaaggtctgctctgtctcttcatctaacgttgggacttcttctaatggaaacgaacattctagcatccggtcaacatagtccgagtccatactatccacaaaaactggcttatcgccttcttgtcccgataaataaacactgcggcagtagcgctctccctcatacgtatagaacataatagtctctatggaaattttgtagaagttgcggatatagacatcctctatattcggtcccccgcctatatggcttctcgtatccagccatctcaggatattttcctttgcctgttctatatcttctgcatctgcatcataaggcggtctgcgcctttctccaatgttgaccgctcccactcctgtcgcttctgggataaacaaggatctaacttcctccaaattttgcattccgctataagaaaccccatccctaagcttaccattatatacctcaagtgatattatatagtacaatgataagttattattgggttcaatcaacggaagaatagttacataacctccatctgaataaccaaactccgtatacttatactcgtattcgactttctgattaatacaatgataaaatatagatgctttatccttaaaccatatatcgtcttctattaccgttttcaatgtctgttcaagttcttcttctgtgaacggacaatttgaatattcttccgtttccgtcttatcctctgtcgatgcttcttctatagatttatcttctgccatacgtgaattcttatatttgttactatattccaaagaatatgcaaatacacagaagcatacaaaaacaattataactatacaaatatatgactttttcattgatatctcttttctttgccatgtaagttaccacatttccaacaagactttcactatcattgcaagacatttaacctactttattaccaaccataaaagaaagttcgcttccgtttgtgaaactctcaactttttctggtttatcaaaatttccaaaaaaggttgtgaccttacgcattgatgccgtttcatccagcatccgattgatggatatgttgatcccatgatcggagagttcctttcgcagcaggcaacataaccgatacgccaatacacaagtgaatatgtggacctttatcttttcatccgtaaaatcattccgatccgtaaagagtgctgtctttccaagctctctttcacatatctgattaagggattgctctgattgtgcatagatcagatagatgtttccattgctctcgattagttatactacgtcaatttcttcaatacattttctaattctcaacttcccatcttttttcccttgactcgtccatataaaatcttccatcctctgcctgatagaatactcctgttaaacgctctgcctctggatactctggcacacccaaaataattgtaatatccttcaatccatcttcgtttaaatcttctatgttgatttctataacatcaaatccatttactaaaccattaaattgaaaaaagatttcatccttttcatttgttaaaaacactactggataaggatgtgcaaaatcattagtacctgaaacaaactttatttctccccattgattcaaattggtactaaatgttgtattttcattataattaatgttaagttcatccaccgaatcaaagtcactaattgtatatggtctgaataaatagcttttttcagtatctttatctgtttccccctctacgtctgtaaaataatctaattttgcctcaatcctatcactttcataaaactgaaatgtaatgcttccctcgccattattttcattactaaaagagcatttagccaatccataataaacagttccactaaatactatggcctttttctcataactggatgtggaaaaataatattcggatacatttgtatccgttgccaatcttccttcgatcgcacctttatctatttttgtaaaaacgaagctataacgatagtcggaaaaattttctccctcctcaggaatccatattctcttaagatatttactgtaatcaatcaaatcttcttttatttcctcttgttggtcttttttagaaatacttttttcttcttccattttttccaccatttccggctcagtatcctctgatattttttctgtcacttcttcctcatgttgtactatttcttcaatacttcctttgaaattggtgttcttatcacatcctgttaaaccaaaaagcaaacatatggcaataattattgtctttgttttattatttaacgccattccatttaatgtcattttaataatcttcaaaaaaacaactccacctttgcgcatatcctattctctccgttagcccttctttttggtcgcctgctctttcatatgtagcattaaatattaacaccaaatccaacggattcaggaatttccggctggaagccgatgcacgggcaagatgaatttgcctccattgccgctgcctttcgtgctattttcactattgccttcgtataaattgttgtcagctttttatttttcatggaaataccctcctgaatttttttacatattaccattttttcttatattatttttcattatgcgaaattaaccataatttttgccgaaattagcataaacaccgcgatggataattcaaataagttatccgccgcggtgtttcttccggtttttctctgaaaataaactgataaaattatcgaagctctgataaatacaacatgacccttaccttgaatgtatcttcattatatgtcacatccattgcgccgttgtacctttcaacaacttctctcacattctctattccaaatccatggttcattccatctttttttgaggaaataaaacgattgccttccttttctatttttcctgcatatgtgttagtaatattgataaaaacaagtcccttttccgcatacatcttaaatttaagagttttttcttccgcctgaagcgcagcttcaatcgcattttccaaaagatttcccagaataacagttaattcaaagctatcgatattcagctcctgaggaatttttacctcaacttctacatgctctaacaccgtatttgctttttctatcatataattaagaattccgtcaatgtccttatttccggaataaatgtgctccttaacatttctgatggaagcttccattttattcaaatactctgtcattttctcctttttatttttttccgctaaattatataattcttttatatggagcatcatatcatgccgtaaggcatgaacctgtttttgtgtttgagaaataacttccaactgattggaataaatctttatctgctggcttaaaatttccttttcatatagctgctgatgaatgtcaatcaaggtatggtacaaataaaatactaccatattgataaccagtatccctatgctttcaccaatcagcaggcgcctgttttgtaaattagcatatatcaaaaaaaaaagcatacaaatgcttaatatagggataattaataagatttttaaccccttaatatattcctgcttagcctgattacccaaaacttttgccgcaactaattgacataccagaatcagtaaatccgtaacaatcgaaaaaatttgtgatgtaggctctcccatattataattcaggaacaaataggctgaaactatatcgcaaaccatattaacgcagtatattaaaatagttgccgtcagcctttttttgtaactgccctcgtataacagtgtgagaaaaaacaatccgattaaattagtgacgatatttacagccggagtatggaaagccacaaaaacggagaaggtaagcgcaaaaaaaagcagatatacagcggcttccatttttttacttacttttccggtatcaaaaaaaagctttataaatctccagataatatagacacggaagagattggttattgatgcaattaaaatatcattcgtattcatttcccgccgccctcttttttcctgattaacttttctctgacaatatttctatatggtctgcttatactcagcgtatgcccatttatcatcgttaccttttcgtaggcatactccttcacataatcctgattcaccgcaaaggattgatgaatttgcaaaaaattagacggcagttgcgacattattgtctttaacttgccataaaattctttcttttcccgaaatagaatcatttggatttttttgtcatcactttgtaagtataaaatatcatcacatggctgtttatagtaattatttccaatatggtactcaaaaaaaacttttttcttttcctctaattttagaaatgttcttattacgtctttcactgcatcataagcaagcggttttaccaggaaatccaacggctgtgttttaaaaagatgtatggcatagtctttatgataggaaatataaacaatttgcgttttaaaatcattcaaatcatttcttattaatttccccacatcgattccattcagcgtcagcatttggatatcaagaaaaatcaactcatacctgtttccggcatctaaatcctggcacagcctttctccagaaaaccatggttcaatttcaaattgcacattaaattcctgcataatcttctgaagcatttcttctaagcctgtgcatatatttatttcatcatcacaaatcgcaatccgatacacaatatttcctcctgaatttattgtatatcttataccttcactaattaacattcaagttctttcctaattcagaacacgcctataatcttctgcattttatacctcctaattatatattgttattttatagatatcattagatatttattgcattatttttattatttcaggttttggataaaataaatttatggaggataatgaaatggcacaaaacctttttcccttgcataattatgaccaaaattatattgaaataggctacaatatatcttattaccgaaaacataaaaagctgactcaggaacaattagctgaaaaaattggtatcagccgtcagcatcttggcgctatagaagcgcctaacgttctgcgccagctatcacttgacttattgtttgccatagcggaagctttggaaattgaaccctataaactactgttattcagggaaatgtaacgctattaaaatataatctgtatttgtacattacatatgtacaatatattcttccacaaatctgcttaaactactttttctttctgcattaataaaatatattataatgatcccttcactgcatacgtcattatggcatataccatctgccgccataagggcagggcggcgccggcaatatataatcgttccccgcggctacaggtaacggccgacagggatacgctcgtatccccatcggccgtaaatgcattttcatgctttctatacttgaaacacagttaattcaactatctcattgacatattttcgccgttatgatatttttcaaattagcagcaatatgcaaaggagatgccatgtataaacaacttatttttgagaatgaagtattgactgcatacacccatcacctcatggctccggaacacgtccacgtaaactgtgagtttgttctggtcactaacggcacagcgctcaatacggtaaacggtgtctctgaaaccattgtcaacggggatgtttttttcctaaatcatcttcccctgcacagcattaccgacctgagcaaggatcatgagcatatagatttatacatcacccgtgaacagctcagacagatctgccttaatttattcaacgaagaattatatgattttttaatgaaagacgcctctgaaaaaaaatgtaatctcagctatgatgaattcactgtaattgtgaaaaaggcacgtaagctggaagtaaattacatcctcgctaaaaatgacgacatgcgggaaacctacaagaaatgtgtcctctccgttatcattgagatattaggcgtctttttcgagaacctttattcccggcagatcaattgtcccgcctggcttgaggcctttttacaggaaacccagcgccctgaaatattttccatgtcggtgaatgatatcattaatttatccttttattcgcatacctttttttgccagacatttaaaaaatgctttcagcgcagcttcaaatcctatattgatgagttacgttttaaccatgcaaaaaacctgttagccacaacacaattatccatcctggatatttcgctgaccgtgggctacaacagttcttcgcatttcatccataagtttaaacagatatccggtatcactcccctgcagttcaggaatatcatgcagcaccgccagtcatgagctgtaccgtgtttgttcaggcaaaataatactgcagaaatattttgcctgaacaggattattcctcttctgtatccttctccggctccctgatcttatatgtaatctcatattctcccgctgtaagatagcagacgttttcccgtacacattcaaaaatgggattctttttatccgtaaaaatttcagccggtgccagaggcagataaagaacagcctcacacccgaacgggaccgaaaatgccagccggatatgacattcatcttcgaatttccaggcggatttccacaaaccggatgcagaattatactcacacgccacctgtcccacacgaggatccggtaccggcgccaatattactttttggaatccgacagaatcctccgcctgtctgatacccgccatatacgaatacatccattccacaacggctccataggaataatgattcagactgttcatccctgtggaagagatacttccgtctgccaaaacactgttccatctctcccagatagtcgtggctcccagcttaacctcatacagccatcccggatagtcctcatttaacaaaagatgatatgccagatcgctcatcccggccttcgtgagctcttccagaagaatcggtgtcccgacaaagcccgtctgcagccggtttccattcgattttaagctcctcttcaaatcaatgccggttctttccctgtccttacttaacccatggcgtaaagtcagtaaatagcctgtctgtgtattgacacagctccgtccgttcggagaataatattccgccctgatttcctttaaaatgttgtctgacaaagcctcatatttttcagcatcctccgttttcccaagaatacgggcagtctttgccgtcagctgcgtgcttaaccggtaatatacatcggcaatgaatccgtcatccgtcccgcctttcacgccttctgtgccgccgtctccatcaagggccagccagtctccgtaatgtacggccctgcgccatccatcttttttcccttctgccgtttcattgaccgatgtcatatagtcaacccaggccttcatactgccgtaatgcttttccaatatgccggcatccccataaaaacggtacatattccagggtatgatcgttgtcgcatccccccagacagaggacgtactgtccacgtcaaaggccggcaccacattcggcaccatccccccgcggctttcttgctcggtttccatgtcaaatatatatttgtagtagaaggaataacaatccctgatatagcatgccgtagcggaaaacacctgtgcatctccggtccatcccatccgttcatccctttgcgggcagtctgtgggcacatccacaaaattgtccttctgtccccattccgtatttaaaatcagccggttcaataaaggattgccggtaaccagactccctgttctcggaagtgaagaataaaccgccaggccgacaaaattatccttcacgctatccggcatcggagtatagataacatcccttttttctccctccattaccgcataagcttctgccgtatcttcgcagagggtcttttctattttcacataacgatatccataaaatgtaaaatgaggagtaattgtctgctccgtgccgttggaaatataaaaatattccgatcgcgccgaccgcagattatccctgtaaaagtttccctgctgcagtatctcacctgtctgtatgtgtattaccgtcccttcaggctcgtttacacgcagtgaaaaaatgccggttatattttggcccagatccagcaccgtttcacccgcaggcgtatgaatcaggctttccgccggaaattctgtcttcaccgttaccggcgtgctgagcctggccgtcagctttcccctgggtgcttccacaaagactgcgctgccgtcctctccggtttttcttgtatcatccctccattccccatcataaatgccggagaatacaagattggatgtccttaccttccagctgtcatccgttccgatgatctgttccgaaccgtcctcatattcaatacgaagctcggataacagtttaaaaccatcgccgtaatagcctttttcccaatttccggcatatccgaatctccctttataccagcccgggccaagcattacggacaaggttccgctctgctgtatcctgtccgtcacatcataggtctgatactgaatccagctgttataattattacagtaaggcgtcagcatctcttcaccaatcttgtttccgtcccacatagcctcatacagcccgaggcccgttatgtataaccgtgcacggctgacccttttggcaatctctatctccttataaaatacagggctttccttgccttccgccaaacagccgatccactttccctcccagttctccccttccttagcgctctcaaaccaatgtacatcgctgacagcctcctcatcctcatcggtacggacacataccgtccagtaataccttgtcctcggcttcattttcatcataaccggcgccgccagagagctgatatccgtctgatatcccgtatctgtaattctttgctccatccttttatccgctgcaatcaggattcttgcagataccatctttttccccttggcatccgtgactttccaggaaaaaaccggattctcaaagcagtatcccaaaggatttacataatgattcgttttacattctgttattttcatattttccagctttcccttacccttttactgatccgaccgtcatgccttttacaaaatatttctgtgcaaaaggatagataagcatgatcggaatgagtgaaataaatatctgcgcacagcggatagtcctgtcatccacaacagacagcagctttatctcatcgatactcagcagacttaaatctcttttcaccaccaccgtatacaaataagaggccagcggataactggaagggaaattcgaaaatatcagcccgtcaaaatagctgttccattgtgttataaatgaaaacaacgtcagtgtcgcaatcgatggtttggcacacgggacatatacacggaagcacgttgtaaaatggctggccccgtctataatcgctgcttcctccaattcttttggtattccgcggaagaaattaatcataagaacaatattatatacagacagaatggtgggaagtatcaatgcccatatggtgtccattaaatgaagattggttatcagtaagtacccgggaatcagcccgcctgaaaacagcatggtaaagaaaaacagccacacatagactcctcttgcccgaagctgttctttctccttagaaagcggataggcaataaggattgtaagaatcattgacaacggcacccctattaaaacccgttccacactctttaacagagacgtccagaattcctttttttcaataacatattgataggccattgtcgtgaactctaccggccatagtgtaacctttcctgcggcaaccgctgtggcgctggaaaaagacatcgccagaatagtcagcagagggagaatacacagcagcgccagtaatgataaaaacatataattgacaacgctgaaaactgcacgtcctttttttatttttttcatatatatactcctgcatttttattactcaaacttcacccatgcccctgtcccctccggcccctgttttcggggctgacagccagtttggattttctttcccctgcgccagccgtgcagggtttcctgtaaggggtgtataaactcgtcggtccttaggccgcgtattttgcggccttagtaccgctgcgtgtttatccgagcgaaagtgtcccctgtaaggattcctgtacggctggcgcagggggaagaaaatccaaacaggctgtcagccccgaaaacaggggccggaggggataggggtatgggcgaagtttgagtttattacattaaaaaatacggtaattagaaaacttatacgccaggtaatatgatgtggaaataaagatggttgaaataatcgatttgaacaatcccaccgctgtagcggctccatactgcgcatcaataagacccagcctgtaaataaaagtatccagaatatctccgctctcatagactgcttttgtatacaaattaaatacctgatcaaagcctgcattcaaaatattgccaaggcttaataccatcataagtacgacgatcccccttattccgggaagtgtaatatgccatatctgctgcaggcggttggcaccgtctgtttctgcagcctcatataagctggtatccactcccactatggccgccagatatacaattgcattatatccgaaggttttccagatatctgttacaatcaaggttcctttgaaatacctgttatctcctaaaaagaagatgctttccccacccagggaatttataatcccattaacgattccggagcccggagataacaaatctatgaatattccgcccaaaaccacccatgataaaaaatatgggagatataccaccgtctggatcgtctttttaaatttaatatgacgaacttcattcagtaataatgcaaaaacaaccgggactaaaaggccgagcacaattttccatgcggcaataataacagtattaaccattgcctgtttaaaccccggcagggaaaacacataggtaaagttatctaacccaatccattcctgatttccgaacatacctttactcgggataaatttttgaaaggcaatgacaagtcccgccattggcacataattaaaaataattattaatattatcccgggaaaaagcatcaagtgaagaggaaattcttttctgaatttggctaaggagtatttgctgcttttacggttcactttttcacctctcatagcttttcaacgattagctgccggcaaagagctaagtatgtacagctctttgccgcagcgtaacctgatatatttcactaaagtttttatttattggaggaataccattcgttaacctctgcggtcatatcattgccgccggcatttttccattcctcaacaaccttatcaaacgcatctatcttttcctggcctgaaataatcttaaggaaggtctgatccagcatatcgtccaaggttgactttttggcagtcatgacttcgccgggtgctgaaacgaatttattatatacaggcgccgcattttcaggatcctgatattttaacaggatactctggccgccctcttcaccgaatacgccaagccatccccacatggagtcatcgccctgcagggccttatagcagtactcccacatggaatactgttcccctgtcaagtccccgggttctcctgtttttaacggttctgcaatcgcttttgttgtagcctggtttttgtccggtgtacttgtaattccgaccggcgccagtttccataccccttccactccgtttccgggatttgcatataccgtatattcgttcttttccggatccaggactttttcgcagtagagattcattaactggattaaagcttcgggatgttcgcagttcttactgaccacataccagcttgtggttgccatttcaattcccggagccgctttttcaccggcctcttccatgggtatcatgaacggtttccagtctgcctccggaatggcattcttgactgtctgcagaaaatccagaggcgttgcatgaaatccgtacatggccccgcatttcccgttgacaagtgcttccgctgccttctggttatcatttacgtaaaactcctgatcgatcagtccttctgcatacagctctgccagggtactcaatgcctgcttcatctccggtgtcgtactgccgtaaaccaggctgccctccttatcctccacccaataggtcgggtatgcatggtatgcgttgcaaattccctttatatcaaactgattcccatacaaatcattccccatttcaagccctatgccgccttctcccgcatagtccttaaatgcacgcaatacttcttttaactcatcgatacttgcaggtgcgcttaagttcaatgcatccagccagtcctgacgcagccacaggatctgcgccctctcaatatcgctgtcggaaatcggcagaccatagaccgcaccgctataggtaactgcatcaaaagcactgtccccaaccgtatcatacagttgtttcacataatcactcgcatattcatcaatatagggttttaaatccacaatcagatccgcatccactaatcttttcaaatcttcttttcccacacttgctatatcaggaatttcaccgcttgaaatcgcagcattgaatttttgtttatagagatctccatctgatgcgatccaaagatacgtaacatcataccctaatttttctgcgattaaatccgtccagatattatcctcatatgtactgccttccattttagcaaagacgctggattccactgtggaatcctgtgcccggacaaaggtaagcggagcaagaccttcactctttgcagtcccgtcctcacccgctttctgactttcttccagcttttctgattccacatttgctgtggtactgccgcagcctccaagcgctgcgattgccatcatcgcgctcaacacgattgctactgttttccttttcatgataacctctccttttttatattcagccgtgaagccccatccccttacgggactacagcaactgtttcttttatgcttcgcttcgttaatacaatctaaacattactactaattcgcctttttatctgtcgtatttttttccaataatatcgttttttaacgtaagtaccatttaaagaaacaacattgcctgaatttattctgcttgcttcaaggtcttttccatcctaaaaaaatataggtacagaataaaagtgaaaatcacttttatctgcacctataatgtgagattaccattgcgttttattaatagtttttcaaatccatcaccataaacccagcacccgctgcagcgtaaggctgactattgtaatggcaatccagcagacaaatcccagcgtaatcggcttagcgcctgtctttaccagcttcaccacatccgtattcattcctattgccgccatagccataacaataaaaaatttactcagctgcttcagcaggccaaagacctcattggctgccgccagggccgttcctgaacagaacgaggtaataactgttgtaatgacggatgcggcgacaaaatagagaataaacatgggaaatacggatttcaggctgacagcctttccttccccccggttctccttctcctctctgcgcattctcacaaatgcaagggcaagcgttatcggtataatcgcaagggttcttgtcagctttactatggttgcatattcaagcaccgctccgttcgttccatgcagggtatcccatgtggatgccgtcgccgtgaccgatgaggtatcgtttaccgccgtccctgcaaaaagcccgaagcctgaatcggtcagcccaagccagcctccgagggcaggaaacagcagcgcggcaatcacgttaaacaggaagataacggatatcgcctgtgcgatttcttcatcatccgcttccattaccggggctgctgcagcaattgccgaaccgccgcagatgctggagcctatgccaatcaatgccgctgtcttcccgggaatcctgaggagcttatacataataaatgctgctataagagacgtgctgatagaagaaacaatgatgggaagagaagtcatcccgactttgccgatagtagccagattcaggccaaatccaagaaggattaccgcatactgcagaacctttttcgaggtaaatgcaatcccctcaccgcagccttttttatccttcatccatatagcgagcaccattcccacgatgatcgcgatgaccggcgcccctatcacttccaatgcaccgactgctccgaccagcagacggcacgccaatgcaatcagaaaacataataaaataccttttccatttttctttaaaaattccatgatccacctcatttgtttttttctcccagattatactattaacaaatgataatgtacatttatatatttttataaatcaataagtatttcttatgcatcatcatgctatgattggcttaaagcaattatccctttgaaatcaggaagctccttccgagtaattaccttatcattgttataaaaatttttaatgacgctgcctggtaagagatgatcggaatgcccgccgcagcccggctcccttatcagataatcctccccccagagaacacagccaagccagtatatcccgtctctggccgcattttcgggttccggcagaaaaccgctttccgagagcataaccggtttcactgtatctgtatagtccagagcattcaaaaacttatccccctgggcgctgatacagctttttgcaggataaatatcctcaccgataatatccacataagcatctcccggataccattcctctcccatcccgctgtatacccatatcaggttatgcaggttatattcccgggtaaatttatcaaacatcagcctccagagctttttatagcagtccggccctccccggctccaccagaaccatccgccgtccgcttcatgaaaaggcctccacagcacagggatatcctgtttttgaagcttctgcagttccagggccatcctgtccaaatccttcatcagcagttcgcagccttctttatccctgccattgagcacagcgtccaggtcaatggtggtttcgtctgcatataatgcctgccaccattccccccgcacatatctgtccggcagcagccaatgccaggaaagagcgataattccccctttttcccagtattcctccgcccactcagttacctgcggctgcgcgccgcgttccgccgcagtcagggaatagtccttcatatccataccgagtatggccgggtactccccggtcagtctgtttatcagctgaatttctttgccatccggcccatataagctatattgtccggacagtattttctctccataaatgccgcacaggtatttcatcagctcctctgcacaggtatctgcttccttatcggcgagtacccctgacgcctgataaacttcatcgtccatcggagccgattctttcagatacagacagtccaaatccagccatccccaatccttttccagggtgatcctatgttctccctgtgtaaggtacaccctctttaatacggaatccagaaaaacatcggattcctccgtcaggagaatcccttcacactttccgtccacatatattgtattttctttttttccgcctatgccggaagcacggaataccagatcataaaaaccctctttttcattatttacggtgaatatgatttgatccccgccctccgtaaatccgctcacataggatgttccggaaaaatcctctttatccgtccggcttactatatttccccggatttgagcatcctccgcttcatatcgttcctcatgcggtgtctcttcgcccccggcaggtttgtccgcagtatgttcacctccggaaccggtacacgcggacatacaaagtacaaatgcgcaaagacatcccagcgtttccgcctttttcataatattattcctgctcattaaataatttgggacagagatatatccttgagcctttgttgctgattttcctcgccggtattcctccccaggtcgttcccggttccgtaatatcttccactacaacggcattcgcgccaataagaacatcatctgcaatggttatatcgcccaaaatttttactcccggaccgataaaacagttatttcctattgtagctgcctctctgcttcctttatttcctcctattgtaacttcctggcacagccggcagttttcaccgatttttgcgttctcatggactaatatattcccataatgtgctagagaaagtcctttttcacacgtgtttgggtatacgataaagtgaaggcggaaattctgatgcttatgccgaaacgtataatataaacagaataattttccaataattccttttccgcagttcgtccaatattcaagcttacgcagtacgataagatacttcattatttcatccccgaatatatgggggcgttcgtgatccagataagacgcaagatagtccctgtataaatattctttcaagtctgcctttgattcaatcattcattctcccccctaatataaaattctaagccatgaatatttctgtgtatggcttaatctaagcacagcttccgataaaagcaaagaaactgtaactaccactatatactgcacaaacatattaactaaatctttcttccataacaactcaaggatcttaatcatacaccggtagccaaaattcaccagcatatgaaggtaataaaacatcatactcagttccctgagtttcacatatattattctgtccttcagttcaatatgcattatgaaataaaacagaaagaaagcagcagggatcaggaagaaccccatttctccatttgccgttatcgtattaacaggaaaaataaaaatctccatatagccaaacagcatggacaggaaaaaaccaagaaatacagttatcccttttaatcttatatttttttttgcataaaacagccctaatgcaataaacacgaatccaaaaaacaggccatagtaggattgcacccatataccaagcgcataaactgcaaacgcaaaacaaacgattgcaaaaggttttaaatggatatacagacataatgcggtcacagcagtcccaatacacaaagatgccaggaaccataactgtgtatatgacgccccgcgaaaaatatccgttactgcataaaaaattccttcttttattcctccatacggatatttgatcactttatccacgataatagccggcgtataaagaagtgtccagacaatatacaaccgcaaaaatttcataatatacttttttatctgccggtatccgtccttatcttccttaactctgcgaaaaaggaaaaagcttgtggacatgaagaaaaaaggaaccgttacgcgcatagcatattttatggcaaaatcattccaaaacggaacgatatcctgaagaaaatttatatgtccatatgcaacgcataaacacatcaaaaattttgccaaatcaacggaattataattttttttaagcagcattgttgtatctgtcagggatttatccactattttcatctttctgccgtcctttcagccagccacccatatatggttttctcatggtggactgtttctttttgaaattctccccggtaattcaatttgaatatacagctttcctccgcagcccgcctgacagcgctttccgaaaagggagcattcagcaggccctgcaattcatgacagccgggattgtttaccgggaccgtatctatcagactccggatcgcttcgtcgttttcataaaggaagtcgatgagataatcaatcaggaaataatcgatcagttcctcctgattcctgcagtaagcatacaaaaggtccctgcatgccgcgcaaagcgggcatcctttgggtgcctttataaaaaatccgctccacctgttttcagaaacataagtcttatcactcctgcccttcaccgtataaaactcataacccttcatttcttcatccgggctgtccataaggtaaattgtggcatcgcaccagatgcctccgtattctgccaacagggacatgcggagaatatccgagaaaaaggcgaagcttatttttccttcacccagctttcggtatacaaagtcgggcagctttatgtaattccttatattttcttctgtaataatcacaacttctctttccgggaaatgttctctcagactccggaagcatatttttaccagttccggcgcatgttccggtttctgccaccagaaacaccagactcttttttcctccgttttctgatcgtcgttctgcttttcctctttatggctttctccgccgtattctatacctccgcaaaatgcagcaatccagtccttaaccgcttttctccgtttcatttccatggaataacacatagaggattttgagggaagcagtctgcacaggaaccgcagccccagtaatttatacccgaacgcttttccataatccagcttaaacaggacagaaaggcgtccacagaccgccgttatcagcttacgcgcatcctctctcttccacgaaaccgccgttatcagaaggaaataacagattgttcccacgattccttttataatgagccagaaaaaattatattccggcacaaggctgccaatcagaaagatcgccgctgttacggcagtgataatcacaaagttcagcagatactgtccaaagaatcgtttcagctttttgccgtattcctctttaaccgcatatttaaaaaacacatagggctccacccaaaaagaagtgaacaggaagcttaaaacagtccccatgaggatgcctgcgatttcatatttctgtacgagtattatggataaaaccagatttatgacagcttccagcaccggcttataccgatcataccagaagacacccatagtatcccggaagcacatgatgacctgcctcatcccgccaaaatagaaatccatcaaaataaggcagacaacaaagggtccaaacacatattcacttccaaaagtcagcgtaataaaaggcttgaataataatgccatcatcgcaacgccgtaaccatagcagatgaaggaagccatatataaaatccggtagacttcatatatcttcccgctcttttcactggctcccagattccccacactcgccgtaaatgaggcgaatatctgctggaagaagagagcaacactggaaagaatcagcctgtaatttgagtaaataccgacactcctcagacctacaaatgccgacataagcaggctgtccgtattatacacacaaacagcccctattttatgcatagacatggccccgatatttttatacagcttccgtttttcctctttcgtgggaaggctgcgtttatccttatcaatatacggatacatcttccctgcctggcgagcgattacccaattggataaaatattgcatacaatctggacaagcagataaaggctgtagtttttcgttgccgcaagaaggatgatctgaagaagatacctgaggacggtaaatacataggtgatgaaattgcttaaatactgcttctgatgtgcgaaaataatcgatgcacggtaggtaagcagataggaagagacggtctgaaccaaatacagcacatagtaaagcctgatatgctcaatctgtgttccgccctttataaaataatcaagaaagggcagcaatacaattcctgccgcggcaacccccgcagcaaccagacggtacagccttctgtacatattcagaagctgggttatcttctgctcatcctggtccgcaacaggtttatacatgccatacagcatggcggtgcctattcccagttcggtaacggacaacacattgaaaatattggacagaaggccgtttactcccaggtaatccacggaaagatatctgaccagcatggagcggcctgcaaaagctaatatcaggttaaagaactgcccgaacacattaaccatcatattgattaacgaacttttggttctcataccgttaccccgtttgcaggcatatacacccctgccttaactaaaattttttccagatatatatacagatacaacagcaaaaaattttcttcccgcatggccttaagtatttttttccttataaaggtaattcctgtattcacttccgttctgtgcagtgcggtacagaagccgtcatacttaagcagcttacgcagctctctgtttttttccctgtaactcaggccgtttccgggacgcaggtaatatgccgcccccatataggccgcataaagcttgttgtaatcaagtgccggtattgcctcttctccctttttctcacttactaatttatccatataggtaaacagtctgaccgcattttcataaaagcctccccggtatgccttgctgccggttccctgtatatttcggtaatggtacattcctttattttcacataccacaacgttttccgcattcagcagacaggcataaacacagcacaaatcttcacctacactgatcttcggatctacagaaatcatgttggggactatcagttcctttttatatgcttttccccaaaaagcaggattaagataatatacaaaaaaagtgccggaatacagcatgttatcctgaagcgttttcagtgagtctccattgtatatcccgggatggaccggatatttctgaagcagtgtcttatttgcagattccagataattacttccggaaatcaccatatccgcctgattctcttcaatcaaatccctgtatacctccagcatatcactgtcaacccagtcatcactgtccacaaaaataatatactgtcctcttacaaacccaagcgccgtattccgcgctttgactactccctcattttctttatgaatcacgataatgcggctatcctgcgccgcatacctgtcgcagatttccgggcagccgtcaggagaaccatcatccacaactattacctcgaattccccacaggtctgtcttaagatgctgtccagacattcctgcagatatttttcggttttataaacaggtataataatactataaaatgggttctccaagcttatctcctttctgtcagttcctgacacacataattactcaggagcaattgtccctcggcattcggatgcatccctgttcccatctccggattataatcggaatacacttctttgggatcccgttcttcgataccgctttttttcagttccaccaccttcaggccgtacgcttctcctgtactctttataatctcattggcctcgtccacttcaaaagatacttgtgacggccggtaataactgcacagcacaatttccgcatccgggtaccgcgtctgcgtcctttcgatcatttcctgatattccaaccggagctcttccttggagcagcccccgaataaatcatttgcccccagcagaatcaaaattaaatcaggcgcatgctcaggcgtgtgcagactgacacatctttcttcatttcctcctgtgccatctcctgccgggagcacccctgaaccgctgcagccgttaatccggcagatattcatccccagcttcaaagccgtctgataccaccacatcgaacttacccccataccgctgtcagccccgtattccggataaaagccctgcgggatatatccttcgtaagaactgatactgtcacccaatacggataaatactttcctctatatgtgctttccgattccgctttccatgtgtttttcagtctcagattggacatatcgtcattatgtacggcaatatataaggcgtatgcattttcaggcaccgtgatcgtatgttcaccgctctccagcctccacatggactgaaagcttccgtcttctctgcagctcataatcaaatgctcctcatcacgggtgaaatttatgcacaatttttttaacggctccatctgatccccgcatacgacaatatatgttgaccagctgtccgctttatcctccgttattccttcttccgaccatcgataaactgtcccttctctgagctgatataataaatcacgcccttcatcctttcctgacagcgccctcttatgataaaaaccgaaaaataagagtattaccaccagtatcactgccgtcagcccaattgcagcggctgccctgcttttccgccttttcatattttctctccgtttaccagttcttccactattctcaggtaaccatcaaccgacttttccagggaaaagtcttccgcccttctgcgcagggcatccttgtcaggcatttccttcactgaccttcttactgcctgtgcaaacagctcttcttttcccggctccaccagcgccccatattttccatgggcaaggatttcatcaggaccggagcggcagtccgcactgacgatacgcgccccgcaggccattgcctctatcagcacagtaggaagcccctcatatcgggaacagagcactaccgcatccgcattcgcataaaaactatagggattcttcgtataaccgtaaaaatccaccgcattcccgattccaagctgttcacacgctttcttcagttcctcttcaagttccccgattcccaaaaggataagccggtaatccgcatcccggctcagctgactcagaacccttaacataaacatgtggtttttttgatagctcagacgccccgacagcacaagcgtatgccatttcctgtctttcacaagccagggatgtccggtatcttcttctgccatccggcagatctgcggataaatgaccggattatagaccgtaaccaccttttgtccggaggtattgctcacccgcagatagtcctcacgaactccctgtgagacagcaaccacgcgatcgaattgtctgtccagcagcggaatggctttttcccggaccttctgaaaactatgtgtctccattgacagtgtattgtgcagcacctccaccaggggaatttttctgcggcaaaacaaagcggctatggcggcaacctggctcatctccgcagtgacggagaaaagtacgtcgtatttttgtcctttcaaaactccggtcaggctgcggatgtttcttatatttttctcaagcttcgaacactccgcaatatccatatcaataaccggtatctcctttctcagaagataccggctttccccttcaccgctccggacgataaaggttacctcatgcccggcttcatacagtgcattcgcaaggaccaccgtcatccgttctgcgcccccgccgtcaaactgatgcataaatataccaatgcgcctctttattgtctgcataatttaacacgctccttttcagcctgtttatcgaattcatataccataacagcaagagcgaccgcgatattcgggaaaaaaagaacataggtattatctgtcagataggtaatatagctgttgaaaataatggcgaatacaatgatcccatggtcgatatttctcttcataaaataccccacccggataaagaacaaaccgaacgcccatatcataaaccctgcgaagccctgttcaatatactgcctgagaaaatcattatgtatatcagataccccaacacgtgtcgttatatctcccatctgaatcattttagtaacaaaaccaagccctcttcccagatatgttatgtttaattcataatactgccgcatgtcctcatacatatagactctcgccatggtatcgatccccagatccgtcagccagttaaacaaaccgttgcctatcagccacacatatacatatgcaccaataccgcatattccgcacaaaaacaaggtggcctttttaccggtctctttgggaagacaccgcagaagccatcccaaaacacaggctacgcctgccgacaaaagcacaatcctcttaatgcttataatagaaaacaccagtgcaagcaagatagctcctatatgcttttttttatttccctttgccgaaaccacgaaatacacaatataggtcgccaatgaaaactggagcgatacattttccattattgtcatcaagggacccgtttccagagaaaaggtggccatcagtcttatgaattccccgacaaatgctcctattccaccctgcagaacagccctgacagccgctattgtataggtaagggacatggcggccaaatccataaaaattcccttttccccaaaaagatagagggttgcagcagctaccagaacagcgattatctgataaactgccacaaacacgcctctgactatgactgcgggttcggacatatccagcagccagacaatcagggaaaagaatatgctgacaaaatatagaacggataagataccggaatattttaatgccagtattccattgccgatattcggttttataagaaaggagatacaggccagcagaacaatcccgattcccagaatataaaagtaaagaatatgatacccgccgaccataacacctacatcttcaaaggtgaatgagcagtacagcaatgtcattaatataagatagacagccgatatcataacttttccgattcctttcatatccggctcccttcctctactctgtcatttctgcaggctttatatgataaagcgaattcataagcaatactttaatacggtaaattccggttttctttgtttctgctatcccgtattcaaactctattttacattcttcatccctgttataatccatgaccgcgttcctgataactcctgcataggcttcggcctgctcttcggaagtctcctttgcaaaaaccacaaattgcccgatcccgttaaccgcaaggaaacagtcgtcatttgagctgaaggtctgtttgagtatattggcaaaattcctgatcatctcatctgttttatctctgccgaatttattatttttctgctgaatatcggaaagcttaaaggtgatacagctgaaagaatccggcagaagctttctgaaggatgccatataatggtcgcatccctccctgttgggaagctcatatttattgtctctgtatatataatattcaaagatatccagcaaacggcccaccaccataaccagtacgctcataacacatgcaaaaataacaatgatcaaagcggcataaagcatcagcttatactgctgttcgattaccacattggtcatcacgctgatattggcagctcctgcatattcattatactcactgttggtcacagacaatttcttatataattcatccagtctctcaatgagtgaagtcattctcgaatccatctgctcaagagcctctttttcgcttaccttgcttactgtgggaagattttcggcctccgcattttcttcttcggcctcctccggattatcctccgcggcttccgtattttcagccggccggccttctttctcttcttcctctccttcctccgtttccgccgctatcccggtttcctcctcaatatttacagccactccggttcctgtctgttccgtcccttcaaacacttcaataatatattcataataggccacatcaatcaaagcagcctcaaagctctccctgtcccggacataatccttcatcaaagtatcataactggtcatcctgtctgcaggattccattgctccgtattgttttcatcctgcacatacccctcatgtacattatcaaggatataatctgagctgatgtccgtatttcccgattcacgcatcatatttacgtaagaatcgataatctcctgaattccttttatttcatcctccgtagtgccgttcttcctgaaaaaatcggcaatccggtttctgtacttattcagcagcttttccttgtccttcgtcactctgttatttaatatgtaagcgtaaatattatttatatctatcttactcagggaatcaaactcatgatacaggtctgcaaaggaatatccgctgtccgaggaacggtaataaaaattattgtttgccttattcaaaagattctccagcgtaccctgcacggaatcatcaataatttcaatcatttccagatagtcataatctctctcatccagctttgaaatgttattggaggatacctcgccgtttatatggcgtgccccgtataaaccgatataggcatcgagcatatgatccaggacctgccttgaaaactcttccggctcacgactgtccttgcgtgtggcataaaaggagacgctgaattccgtaggcttttcctccacaacctcgcccacctcattttttgcttcctgtacggcttccatttccggtgtgaccacttcctccacaactaccctggaacggaattcatccagattaaattcgctgtattccatgcccatctgctcaaaaacctttgacataacctcttcggaatagatttccgtgacatcaatatcgcttccgtccggagccagcccttcttcggcacgttcattggtgtatctgatgacagcagttgcggtataatgctgtttattcagcattatcagataaaaaacacctcctgccagcagggaaaccgccacaataaagatttgatattttttaatatatctaagaacattaaacgactgcataactgctctcctcttcttctccatttcataacaatggcttttgtttcccggctattttcttcttttttcccgtacgggaagtacaaacatcagcagtacggataatactaaaaatatcgccgtatataccgcaccctttttcacctggaaccggtctgtgaacttcaaatcccggctgtttacatataccagactcagataatcccccgatgtttttttatcatattcctgcagcgtcgttttcataagctgcgcataataagtgagttcattttccaggccggacagcatttcttcggcctgccggtatttcgcatcctcagcggtgctgttcagcatctgggttatcgtataattatttgtggcaatacccagctgttccttcgttgcctgagacagcctttcttccgcttcccttgcaaaataatccactccgatctgtgtccgggacatgtagaattctctgttttcatcctctgtgggcactaaaacaatagaggccatatccctttcatatttatctatcgcttccagccttacctgataggcggtaagattcttcatgtaataaatattgcttatccggttgatataattcagtttggatatgtactgtgtcctgtccctgaccagtccgttttccaggacaaacgcccggtatctttctatctggacatccctgaagctgttgatttttttctccagggaggtaaaggtttcccctgtctcttcagactggaagctccggctttccgcctgcagcatcaccgcataagtctggacactgtcagcctttgcatcaataatatctgccatatcgagataatcagtattacccgtatcactgaaatccatttccagtatgttggtttttctggagtacatctgaataaatttctcataataacattcagccacggaattgactaccttttccggatccaggcttcttgttttccaggaagccgcatattccagattatattccgtagaaatataatactggtcaatagaaattgtttctccgtcatccacaggtgttacaagcaggcaacccttcagttcctctgcggtcacaccggaaaaaccgcccttcacaatagctgcctccagcacatcgtcatccagtatttccgaaacgctgaacttggtattattaggatttaagccactggaggaggacggataattcaggccgatccgtatagtggcctccgtcattcttgtaatttccagcgacaggacaaagaaagcaatatagattaccccggcaagtatgattatccagaaacggcgtttgaaatgcctcatccctgtcttcagggtatccacaatattctttttcccctgtgccagtatccctgtcaggcataacaaagaaagcaaaagcggaatcccaatcattacataatcaagcagcttacttattttcataattctcctccatccctacttatctcgggctgatatccacaacaaccaactccggtttattattgattctcggtatcagcccatgattgcccagccctctggtcacaatcaggttcccttctccccatggatacagccctccggcatacgcagggaaaaatcccgtatcccaatgaaacagacctccgataccgggtattctgatgaggcctccgtgataatgccccgccactcccaaatccacctttacggactgcagcctgtctgtaaaaagatccggataatgagccatgagaattttgaattcctttccttcttcgaattccgcctcaaactgcgcgtcttcctcattataggtttccgcatttgccgccattgccccaattttaaggacattgccattcaccgtaattgtttcataattcgtatacataaaatggacgcctgcttcatacagatatttatccagaggcacctttttccctgtatacatcagattcccttcatgattccccaatatgtaataaaccggcgcaatctttaccagataaccgcacaaatcaacaataccggatacatctgtatccgtttcatttatcatatctcccgccattaaaataagatccggtttcagttcctgaagctgctttttcagccgctcattcttttctccgaacgttccgctgtgaagatccgccatgataaccagccttagaggagaattgatttgatccgaactaagctggtaatatgtcagttcgatctgtttgttatcaatgaaatcggatttcagaatcaccgcagaacacagaaccacaattatccccagaataagcatgatgcggattcttctgcgttttcttttctttttcaatcggagtatctcttttcttaccgcctcgcttcggaaaccttttctctccaaatcctccaatagtatgcctccagtgttcttatatttttttgaagcgtaaatttatcctgtatgacagaaaaaccattcttgctgaattcttcccgctgcagcggatcattcaaaagggaaatcatcttttcctccagcaaagccttatcacccggctgaatcagaaagccgttcttaccgttctctatcacctccggaatagaggcgatatccgtactgatattcggtattcctctggccattgtctccagtatgctcatcggcagcccctccccatatgacggcaggacatgtatggccgcccttcctaaaaactcctctttcttttcagcttccgcccagccgatatacgcaatccggtgccggattcccagttcttctgcaaatgaggccgcgcctgctgtttcaccgtctccgcaaagatagcattttgtcttttgggggagcttgtcatctgccgctttcagcgcctgaaggaaatcgtaggttcccttcctctgccccagcttccctaaaagaatgatatctgaagcatttcctgtatatggattttcctccggtacattaaccgcattatacagtacctctattttggcgccgggcgctttttccctgtatttttctgccagaagagaactcaataccagattcagctccgcttcctccagcgcctttttcacccatttttttcttcccgccgaaagcgtatgataaaaagcttcaaattccgcgctgtgatgatggaggattaccgggatatggaatctgtggcacagtctttccactattgccttgcggtaaaagcttcctctctcggccatatgtaaatgcgccatatcgactttatggaacagaagcagcttcataatacgcagatatgcagtcaggaaataaacagccttggcgataccagagccttctttgtgagtcgccacaaaaataaaatccacgctcttccattcccgggactccagataatttttaaccacggttaccatgccgcctttaaaggtattgatgtccgagcagcacatcagtatacaaagcctgcttttctccccgctttttttcattgtgatttccccggcctgtatttcagcaccatcctcaaaatttgaatatcatctataaagtatcttttgaacagcctcttgggttcctgaaggaaacggtaaaaccactccagtccatatctgctcatccaggccgggcaccgtttaacatttcctgccaggaaatcaattgtcgccccggcacatatggaaatgcccgccttatatttatcccggttttcgtacacataccgttcctgcttcgggcatcccagacagacaataacgatatccggtccggcactatgaatggcagcattcattttttctatttcctccggctggttttcaaagccataaggaggcgagtaacagccggaaatctgaattcccggatatttcatcaacagattttccgctgccctttctgccacgccctctcccccgccggccagaaaaagcttttttcctttctgtgccgccatccggcaaagctcggggacaaaatcggaacctgaaattttttccggcagaggtgttttaaacagcttcgaaatccagataatcggcatgccatctgccagaaccatttccgactcattcaaagcctgttttaaaagctcatctttttccgcttttatagccacatccacatttacgaacataatactggacatctttttttcttctatattacggaatacctcctcaaggagctgttcctgttttacagcattaaaacggatatcgagcatttttatcttcgtttcttctctcatgcctgtcctcttttccggtttaatctccttcttcccttcccaataaaaaatcaacaaattccgccaggctgccgcaggtgaaatcggcgttttgcagtcctcccactccggccgtatgacagccggccgctttcccggccctcatatccctttcactgtcccctgccatccaggagttcttcaaatcaatattgtatttatccgatgccttcaaaagcatgcccggttccggttttctgcagctgcatggaattttcagggatgcaacctccccgggaaatcctccgtccgggtgatgcggacaatagaaaatatcatccacatacgccccctgttcccccaaaagagtttccatcctgtcgtgtatctcccgaagctgttcctccgtaagctcccctctggctataaccggctgattcgtcacgacaataacaagatatccgctctcattcagcctcttaaccgctttccccgtaccgggaagaagcaccaaatcttccggtgtccgtatatatccccggtattcattcatcgtgccgtctctgtcaagaaacacggctttctgcctgcgggaaagattccgtttttccaccttgcccttcaaaagatccctttccaccatccggtatcgttccggggttcccatatcctttacatattccggtgacatatatgcgtacagctgtctgtcttcaattaatggccggagtatctctctgtccagatccactctttgaggctgtttgaaaagtcctcttctctccgcgtgcaaaaacaatccgggcgacaggatatgtatgcctgcattcactctgtttccataccattttctcttgtcctctttatgcagccattccctgacaagccccttttcatccgcttctattatcccgctgtcaaacggatggtcattggggtgtgttaaaatggttgctaaccctccaaaggtctgatgcgccttataaaaacgctccaaatcaatatcaaaaatgatatctccattgataaggagaaaatcttctttcatggtatccttcagataataaagtgcccctgccgtgcctaacggggtttcttcatttatatatttcagcggaataccgatagtctttcctcctgccggcgccgccccggtaccgtcaccaaaatattctctgatcacgtgccccaaataccccgtaacgagtatcacttcatcaatttcctgttttttcagccattgcagctgatattccaagattggtttaccgcagagcctgaacatcggcttgggtatactgctgtccagagaagctattctttttcccctgccgcctgccatgataaccgccttcattccggatttttctccttcctgcagctattccctgcccttaacctcccggtcttccttttcctcttcctgcgcacctttcagctgtttgatttgctcttccagttctgatttttccttcttcaggatttccatttcactgagcagaaaatcgatatactccagaacatcttctttcttataaccgccgaaaaccgaggtgcgcaatgcctccaatccgttactccaattttccatctgccttcactaccttcttttccctttcgcttatcgcgcttttcaattgttccgtcactactttcccgctggcatttaccggaaattcttcaaaggtatacagatatacaggaactttaaaatcggcaagatattttctcacataatcctgtacctgctccagggaacattgtctgtcattttcccatataacgcatgcggccacctcttcctgaagaacctgcgcctttatccccaccacttttacttcttttacctcaggcatctggacaatcacattttctatttctgccggggcaatattttcccctccgcgcagtatgatatcctttatccttcccgtcacatgaagatatcctgcttcatccagatatccccagtcctgtgtatgcagccatccgtcctcatcaatgacctgcgcggtttcctcgtctttcctgtaataccccttcatcacaagatatcctctggtctggatttctccctcttctcctgccgacgcggcccggttttcctcttttctccatatcctcacctccacatgctccatgagggttcccgaagtgcccgcctttgtttcgattgggtcgtcccaccgggatatcgtcacagccggagatgattctgtctgtccgaatgccgtctgcagatggggtatcttcgttttttcatatattctgtagtattcagagggtataatcggagaacctgccatcaaaccgctttgcaatgagctgatatcatattgagagaaatgcttattatggattaacgcaagataaaaagttggaactccattaaatacggtacagcggtatttctcaattacctccagcgcctccgtactgctgaagcagggaagcagtctcaatgaggccccgctgcatatggcccccaggattcccaccgtaacaccgaagcaatgaaataagggcactgcagtgcacatgacgtcacttctgctccaatgcatccgttccaccatgcctgcggcattattcaccagattataatgtgtcagcattacccctttcgccctgccggaagtaccggaagtaaataaaatactgatcacatcatcacaagacaatgtctcttccatccttcgcagcattcctctgtcttttgcatccgttgtttccgccttatgcaccatctctgtcatagagatgatctgtttcaggcagggcgttttctctctttccattttctgaagtaacggaaagagagagccattttttccgtcactgtaaataatatatttaatatcattttcccttaccagcacttccagctcactgatcgcaagggaaatattcacaagaacactgatcactccaagccttgccagtgccagatacgtaatcacccaatctgtgctgttgactccccaaacagccgcatgatccccttttttcaggcccagctgcatataaagcagggccagcttttccgcggaatcagccgtttctttccagctgcagcttttatggccgtctccgatacaggcagcatccggagtcagccgcacccgttcctccaataattgtccgattgtaattttcctcagttccatctgttttctcttttcctatatctgtataaatatccccggcttaatgatgtatctccgccttttcccatttgttgctgtaatcgtcgtaccagacatcatcctcgatcactcttttttctccctgaggcacataggtttccggtacataataaataacgcttgtcccctgttcttcaaaacggaaaggcacataaagcaaatcattcagcgcatagcggaccgccgcctgcttatcgagctccgcgtaaaacaatataaatccgccgcccccagcccccagcaccttgccgccgagcgcaccggctttcttcgccttctcatatatctcatcaattttttctgttgatatatccttattaaggcttcttttcagtttccagctatagtccagcagacggccgaaatcatttaggtcacgttccggatttaccagaattttttcagcttcttccgtcaggcttttcatttcaagcaaatcctgtattttgtccttcaggcattttcttgttgatacctgtatatcaaaggaaaatctggcaaaaccggtgaaaaacagcataaggtttgaattcagcttcctttttctgataggatatacaatcaccggatccacacggtaccctgtggaatcaaaggttattttattcagtccgccaaaggatgaggcaatctgatcctgaaggccccctacctctttgcataatcccctttccaggtaaatcgcctcatccgccaacgcttttttatcccggtactgtcccttaatcaggtggaatgcattcagcatccccaccgcaaaagaactgctcgttcccaaaccggagtgtttcggcaaatccgcttcataggtcagccggatttcgtggatatccagttctctcatggcttcccgaatcatcggatgctgaacctcactgataaaattaactctttcaatctgtgagtagcagatttcagatgtatattcaaaaaaacgaggcagatgtctgactgtcacatagcaatatttgtcaaatgttgttgataatacggagccgccatattccttgaaaaattccgaaaaatctgttcctcctccaaaaaaagacattctgaacggtgtttttgttattatcatatcctatctcatccctctgatttttttcctgaatccgcctcataatccataaatccgcttttgttttgcatttatcccgatatccttccgtacgcaaaaaagcttttactacagaattatggttctgtagtaaaagctttctcacttttccatacggaaaaataaatagcctattttccggttaaaaatagcgtaaaacctcagcctgttaatgttaggcattaacaggcttattgggttttgtgtaattatttcaattctctttcacaatcttattggattttttgctgctttggtattattttgttgaaaaagagaaattaatcggatataatgtttttgtccgattactatgtaagcatttatattgtattatctacaacagaaccataattctgttgtttttttatataatcagctgtagttttgtaagcgtctcttcatgttccttaaggctcaccgctatataacagcgggtggtctctaccgaagaatgtcccaggatatctgcaagatgtgcaatatctttttctatcgcatagtagcatttcgcaaacaaatgtctgaaattatgagggaacactttattcggattaacaagtgcatccttacaaagccttttcagctcgcgccatatattactcctgttaagaggctttccgtttctgcttttgaaaagatatccgttccgaatccccgcctgggacgcataggataataatttttcttttaatcccttcggtatcaaaataatacggcattttcctttcatatcgatttctgcttttccccttttcaccgcctcaagtgttatatactgaagttcgctgatccggattccggttccgcccaatgtcagcatcaggtaataaagtctgttttcctttttgctcttagctgtctcaagcagcttcctgtattctttttccgtcagttcccgggattcctccgcaaaagcccttctttgtattttcaggaattttaccttccattccgatttgtcaataaattgaagaaaagaatgaacagccgcaagcttcccgttaaccgtccgggcctgataattttttcttaacgcttcccggtattcgagaatggaagctttgcttcgttcatggttctccagaaaatccagaagcaattttacctcacttacatatttctctatcgtagcctttgatttttcgttaattaacagttcctctttatatcttttcaagtaatcctgcttagatatttccatgtccattagaaacctcctgtaatttataataaaaagtattatacgattaacatgcatttgatattaagtccttcttctgtaaaatgattcttccttatcatcggttattccggcgggatattttatagcattcccattattcacgatataatttcctctgagcaggcagtatcataataatttcttatccaaatattaaaatagataatttttatttttgtatacactgtcttataatattcttcgaagaaagaaaatgtcccggcggcagtgcatttccgataccggcagcattttcgccccatgaaataagacacgatgaacccaaggttcagaaaggaatcgaaatgtacgatattatcattatcggcggaggccctgccggaatcagcgcaggcatttacgtggtaagccgcgggaaaaagacacttattatagaaaaaagccagattggcggaattatcggaaaggtttccaccgtcacccattattccgctattgttgaaaatgaatccggagctacctttgccgagcgtctgaaaaggcaggctctgcatgcaggcgttgaaatccggtatgaaaacgtgataaagactgagctacagggagatatcaaaacggtcatgacggaggagggctgctatcaggcccaaaagcttatccttgcaaacggaagcactccccgcaaactggacattcccggcgaagccggcctgaccggaaagggaatggggctgaatgccgccagggacggcgctctttatgccggaaaaaatatgtatgtcgtgggcggcgccgacggtgcggtaaaagaagccctctatctgtcccagtttgccaaaacggtaactatcatccattttgaagatcagctgggctgtatcgctgaatttaaaaacaaactgaaggacaccgccaacattaccctgcgcctctcttcccgccttcaggcagtccatggcagcgaacagatcgaaacgctggatatcgcggatgaaaagagcggaaaaacagaaaccatccaggatcccggctgcggagtgttcgtttatacaggcaccgtccccaatacggatatctatccggaactggtactggaaaacgggtatatcccggtaaacgataaaatggaaacagccattcccggcgtatatgccgccggagatatccgggtaaagcaggtgcgccaggccgcgaccgcggttgcagacggcgccgtagcggcaatcaatgccgctgtctgaccctatctgcgggaaatgcgggatccctgcccggcagcggtcccgcatttcctttttttcagaataaccttccccttacctccccttttcattgaccataattgccatcggttatatactgaatgtatgtatcgatatcagggggaatgtttcgtgtataaaaaaatcatacttacggcaatctcttttttgcttctcttcactcttggaggctgttcaccttccgccgctccgaaagagcccagactcttcggcttcacggccatggacatgacggatcaatccttccgccttgcactggctgagctggaagagctggtaaaccagaacggcgacagcctcatcacttttgatccccagttagataatgaaaaacagcttcagggcatatccgatatgatcagccagggcatagaggtcctctttttaaacccggtagatatcaacggcattcttcccgcgctcagggagtgtcaggaaaacggcgtgaaaatcatctgctttgattccaaggtctccgatgcttcctatatcgaaacctttgtgggcggtgataattacaagatgggatggctcatcggcgactatatcaaaaaagactttccccagggaggaactctggcctatctgaccaatccgcaggccggctccatcctgctgcgtgagcaggggcttctggagtctctggaggggagcaatattgaagtgatcgatgtgcgtgaaatctcacgctacgaggaggttcttcccgcgacggaaaagcttctggaggataatgacagcattgatatcatctggggcttcaatgatgatatctgccttatgatgcatagctgtgcggtggcaaatgaacgtcaggatcagattaccttctatgctaccggcggcaatccggggatcctggatgccgtcaaacgagggaatgtccgggcagtatccgtacaatccccggcggactggggaaaggtctgcggggaattgtgttataagctgctggacggggaagaagtcaattccgattatctgctggaggcttctatcatagatacggagagtgtaaatgcatatgaaatggatcaatgataccggaaaagcatcaaagattttcgagacgtttcttgtccttcttcttattctgatgatcggagccaccggcctgatgatgctgcacgtacaggaacagctgaaggaaaatacggcggcttccgtaaaaacagtatttgacaaatccgccaacctcataaactcggatattctctcggcccagaatgccgtgtaccgttattcccgttatatcaactgggaggatcaggagaaatctgtggctatgctcggcgcttttctgaaggaatatggttgtcatcaggcattttatctggattcggacggaaccggttatgatgcttcgggcaatcattttactgtggatgatctgccctttccggattttgttctctcaaagggggaacagggcttttctccctttttcctggataaggaagggacctgtctcaccgccatgggtattcccgtcatgaaggacggtatccggacaggagccttctatgcggtctatcccatggaaaaattcagcagcaacacgctggcaaaatcaatccggggggaaggttattattatcttctggatagacagaccgatatcatgatcagcgctgccttcaacaccaacgataccggagtcggcctcactaccctgaccgatcttacgggcgttaccggactcactcctcctgatatttcatcacgcattcttgcccctatggatgccggtgaggatttccagctggaaaccagcctgaacggagaagcttacttcatctttttccttcctgtaaaagaaaatccctcctggtatctctgcggcctcatgccttcttcggtcataaaaaaagagtccaacaatacgctggctctcataggaagcatcatcgaaatgcttgctgcattatgtgtccttgtcgtagtgtcctttctgtactttttcctgcgaagacaggctgcggaaaagaaagagcgaaaagaaaaggaatttcagaatgccatatatgatgcactcagtgaaaaaagtgatgtggtcgtctgtattttcgacagaggctcccgtacattggaacaggttttccggaacagtctccggatcctggggcggtccagcgaagaatatctctcccgtccagagctattggaagagctttgccgtctggcggatccttctttatatgaacggcttctggagggaagcatcggggaggacgaggtacaccagttttccatgcagcatccggcctccggagaaatttttatccgtttcaccgtaaaaacagggatttccatcgccggcctcaggaagtatatgctctattttgaggatatcacccagtccatcctttaccaggaaagcctgaaggaagccgccctgactgcccggcaggccaatcgggccaaatccgatttcctgtccaatatgagccacgaaatccgcacgcctatgaatgccatcatgggaatgctggaaatcatggaacgcagccaggataatccgccgcgtatgaaagactgcctgaacaaaataaagctcagcgcagcccaccttctgcacatcatcaatgatatcctggaaatatcaagaattgaaagcggaaaattaactctcaatacagaagccttcagccttgccggcctcatatccaacgtatcctgcatcatccgcccgcaggcggaggcggaaggcaaacggcattcctttgtcatccatattcacggactggttcatgattcctttatgggcgactggacgcgcctgaatcagattttgatcaacatactcattaattccatcaaatacaccccgccggaaggacatctctcctttgacatcttcgagcaggaaggcccggggccggactcttcgctcctccgctttgtcattcaggatgacagcatcggaatgagcaaagaatttcaggaacggctgggcaggccctttgagcaggaacgcagccagctccatatccgggaaggcggaaccggcctgggcctgtccatcatcttccatctggtgaagctgatggacggcagcataaccatagacagtgatacggggaaaggcacgtccgtcaccatcgagctcgtacttccccatgcttcctctgaaaatcaggaagaagaggcggattattccggcctgcgggtattgctggcggatccggatcctctggtggttcaggatgccgccgccattttaaatgcctgcggggcaaagaccggatgtgcttataccctttcacaggcagaggaaatgctccgcgcaaaaggcagcggagaaaactggcagctggttgtcctggatcgttttctggatggaaaagagcagacgctttcccgtctgctctccatccttccttcttcctcatgtcccggttctcccgccgttttcatctccgcatacaatccggcggatgcggccgaagctgcgcaggacaggggaatccatattgtggagaagcctttgttcgccaaacggctcctggatatcctgaaatatgtttcccggggctgccgccagcctctccatacggccgacgccggacagaaacaactccctgaccttccgcatgtaaaagttctgatggcggaggataatgaactgaaccgggaaattgcactggaattcttacatatggggaatatagaagccgactgcgccgtaaatggccgggaagcgctggaacgctttctctcctccgagccgggaacctacgatctcattctcatggatctgcagatgcctgttatggacggcctgactgccacggttaaaatcagggaaagctcccatccccaggccggaagcattcccatccttgctctgaccgccaatgcctttgaagaggatatcagccggtgtcttgctgcaggtatgaacggacatatggcgaagccgcttgacatccatgccctgtttcagaagatggctgatttcatctgattctatccccgcttcagccgaaactgtccggtaagctccttcagccttttcgcctggctggacagttcctcgctgattgccgcagattcttccgccgatgcggtattggcctgcacaatgccggaaatctgttcgatattttgattaatctgtatgatagaaacagcctgttcctctgtggccctggcaatatcctcaacgactcccgccacctttttcgctccttttacggattccagcatgacatcggcggtttcgccggcgattctgctgccttcatttacggcaagaaccgaattttctatcagggcaactgtcgccctggaggcctccgatgtcttattcgcaagactgcgcacctccgcagccactacggcaaagcctcttccttcatttccggccctggcggcctctactgcggcattcagggcgagtatattggtctggaaggcgatgtcttctatagtctttatgatcttacggatctggactgccttttcattaatatcagccatggcgccgaccatatcctgcattttccggttgctttcttccatatcccgttctgtctcccgggcgatctcactgacctgcttcactctatgcgtgttattattcacctgtccggaaatctcatcggaagcggcggccagttcttccacaaaagaagcctgctccacggctccttcggataattcccgggacccgctcgataccagctcactgccggaggccacctgatccgcagaacgtcctatctcctccagcgctgcggacagtttactgataatctgatgcatggattcggtaagctggctgaattcacccacataaagctcttcagtttttgagtctatgtcaaaattaccgtcccccattgcgcccagcccgtctcccatgtcgtggataattccccggaaattatctgtcagcctcctcatactctcagaaaggctgcccaattcatccttcgcattatagctgagaaccgcgctgaaatcaccggctgccattttcccggcggcattttcaatttccttaataggaccggtcaggctcttcgtaatataaacagaaagtccaacggtcagcgccaatgccaggcccgctatgacaagcagtattgaaactgctgttttataggtacccgcagaattttcaaagttttcatccgcatattccgcagttatttcagccacccgtgtcatcagttccttgaactccatcaaacgcggctgatactctttaaacatgatctctgcggcctcatcctttttgttctgcgccgccagctccagaatatgtaaccgaagaggctttgcatcatttaaaattttatgcgcttcttcaatcatggacttatctccgcggaaattttccattaaaaaggcaaagtcctcacctaagctgtcaagcagttcatttgtctgggctatatagctcagcgtctcctcgctgtcatccgtgagcaagctcaatgccatattcttcagccctgtctgggcggcacggcgcatatcggtagccgttacgacaacaggatgcccgaccatataaaattctttaaaatgattctgtgtattattcaggctataaaaagacaaccctattgattcaataaaaagaaaaataataatgccgaatgtgactaccagttttttcccgatttttaaatttttcatttgtacgatacccttttctcattttgccggacggctttttttcttttactgctctatacaaaaaaacagcacgatatccgctgaaagggtaccgtgatcatattatatttatatacgtttagtatagcaaaaggtgtggggaatagcaatcatacaaatcaaatagtgtgttctttttttaatactaaataaatggtataatattcaatattaaggattctgatacagaaatagtatttcagattatgaataagagggaaaatatgatttcagaacaaataatagaggatgtatgttctttatacggaattaagataaatagtatagggaaagtctttgacaattccagaactccttcggataaaagatatatttatccgattaatgacgcctacatgctgaaattttataataacggtaccatttctgaggcatatctgaatgatgtggacagacttataaaaagatataaggaaattggtgtttactgtccatccctgataaaaaacaaaagggaccaatttgccgttttctgtaaacaggacgttgataccttctcctgctatgtggaagaaatggcctgtttccgcttaatggatccgggccggattgactcctttgcttttcgaaaagaacttgtcaaacatctgggtgtgctggcttctgcctatacaaacatcgatctttccgtaacaaaatcaatgtggtctatcatagatctggcccctctggataaagatattgacgaaaaacaggaaaatctagatcggctggtccgctgtctgaaattgcatcaattggatgcagcagccgatctgatcgtaagctgtaatgagaaggccagaatgaaaataaaagagtatttttcagaattaccccgctgtgtctatcagggggatttaaattttaccaatattcttgttgatgacacggattgctttgccggtctgatcgattttaatatgttcggtacggaagtcaatataaactgttttttgaatgaaacattctgcgagccggagccggaagaatataataagtattccgcaaatgaattgtttatacaaatgcagcgccaacaggatgagcttctcaacaggatttgggaaaattactcactgtcggaagccgaaaaaatctgttttcctgaatacaggaagattatcggcctctctcagtatccgattgtacaaagctggataaaaatgctggaagccggaatacataccgaaaaaatatgtgatcttcttcatttaattgccaaccagaattaacaggccgacgttgtattaatgtcttatgctttactccatgctttccacggttcctgctgcttcctcccgggaaagccagccatcccattcatatccctgcctggcttttgatgtatcatataccgcattcagcttctgttcgtattcctcctgcgacatctgtacatcattccactgatactggtaaacagggtttccgtccgcatcgaattccaccctggaattatcctccgccccgtaataaccggcggcaatctgtgtcagccggccattttccatacgatataccagatcatagtagcgatccatattgccgtctgaattgcacagaaggccgcttctttcaatataggtgaaattcagcctgcccagccgggtttcctcaagcatgccgtccgcgtaagtgacaataacacagcctgccgcttcgctggtcccgatttccaccagctccggaatttcatcatcattcagataaatcagctgatatccctgccattcttccggatcctgcttctgcagatgatcgatatatgcctgtttccaatcggaggcctgtgcttccccctgcttccctgcgcccagaaatccaagaaccgactgaaccgtcttttcagcaagggcagaattggttacttcagataattctctttccaatgtaaacaggccgtcttcattccctctgtagatcctcgcctccgaatatcccgttcccacatcaggcccggaggaaggtgaataattacagattattataatatcgctgaaaccgtcgccgttataatcaggaaaggaaacggcttcgaccttattaaatatttcattggccctgatattgttatcagcaataccttccagtgccgtggttttccctccggcttcctgtatttcgaacagggcatctcccagcggattctgctgtgtatccggccgataagatgcaaatgtcacctttcccaaaggttccagcgtcacttcaaaggtctgctccccgatcagccggttctcttccatgccgcctgtttcttcctctgttccgttttcctgctgagcgcccatatctgtttcatttatctgtattgtttcagagtttttcatgtcctctgcctgtgattccttcccgcttccgcaggctgtcagaatgccgcacagtgttatacaaagaagtgatgcctgccatttttttgtgttatgtttcataattctcctctcgtcatttgctgattatccattctttttgtcggttgtaccggtatgcttcctacgcagaactgtgtctgctttatactgtgccgactcccgaatatcatgggctgtttacgccgggccccgggatgagccacaaaaacagcttaccacagagcctgtgatatctcaatcccatattctttaatcacttttacgctttctttatttatgcctacagcccgccgcacaggcactgttcaggccgcccgccgcaaaaatttcttacgaaagcaacagcttccgttcaaaaaacccgccacaattcctgtgacgggctcaaactgataataaagggagcgggaagaatacagacggtaagcggagcagaacagccggaaactgccggcattgctactcgctgtcctcatgtttctcatgaccatgatgctccttcttacccgaatgatgtttttcatccccgttatccgcagctttggtatcatttacttcttcggtatcatttatttcttccgtattattttcgtcttcggcatcctctccgctctcctcatgatgttcgccgttctcctcatgatgttcaccgcagtgctcttccgtaagctgctttatctcacttatggagtgttccgcgcactgctcataagaggcaccgggatccacctcctgcagctgtgtaatagcaagatatttggccgggctcagattataatcatgggcacagtccctgacctccctggtcaccgcataaacatctgccgatgccgtggaatggtgggaatccagcaaggtatccacagactcccggatctcacccagcattttctgttccctgtcattgcctcctgcctgtacggtgacggataccaggccgtcgggggccaggtaccccctgagaatcatttcatccagcagccgttccacggcctgatcccatgacttgtgcctgacatccacatcccgcaggataaccgcgccgtcatcattatacggggccgcctccagaacgcgcccataacggttaagagtcagtgaaatggaggggttcacatccatatccacataagcattgggagtaaaataggaaagcccgcttataaacaaaaacgcagcaaaaacagcgcatgccccgataagcctctgccggaaaatccgtcctgccggtttcctcctccgtatttccttactcagaaaatcggctgtcttctccttcagctcctcttctgcataaatcttgtcaaaggtactgcgaaacttattctccaatccactcacctcctaactgcttcttgagctcctttcttccccggtcaagccacgtatatactgtattttcactctttttcagtatccccgctatttcaaccgccgtgtagccttcatagtaaaacagataaatcacattcctgtatttgggcggaagccgtaaaacggcatccagcagttctttatcctgctcctgtatgtaaaaaggctccacatcgatctcttcgatggaacggaccttttttcgaaaaaagctcttcagaacatcccggcaggcattgatggaaacacgaataagccatgccttttcatgggcatcgctttcaaaggatgaggaatgcagaagatatttgaggaatacctcctgaaacacatcttccacatccgcatcgtttttcaggtacataaaacaaatacggcgaaccgtgtccgcataaagcttcagggcacggttcacctcggcttcattccgcatggcctctcccgttcaatagatatcattgggattttcccattatattagtgatggttttcctgatgatgggaaccggtaccatttccgttatgaggcaggcagacattcccgttatggtcatggcttcctgtttccgtacatcccttttccgtacatgcctgatggtaatcgtgtccatcgcccatataatgaccggcataggtgattccgtcatgctgatggtttcctgatgtattacagttttccgcgctgcataaagagtaattcgtggctgcggttccgctgcaggcgctgctatgtccgtgcccgtgggcagaagcggtcagcggcacagcggccagaagaactgtggaaagggcaaatgcggcgattatttttttcatgattggtacctccattttttattgttctgataagtatacgattgaggaaacccaatcctttcaactttttaaaaatttttttaaaaaatttccttttccccggaaaacatgtatttctgttcaaactgttccaccgccatcggcttctcaacgatatagccctggacatagtcacagccgatttctttcatataatcaaactgctcccttgtttccacgccttccgcgcagcatctggccccaatggaatgccccatatcaacgatatgcttcaccagcgttttcccacgctccgcttcttcatatttctgtatgatacccttatctattttaagtatatcaaaatcagccatcatcagaaattcgtaggacgagtattccacgccgaaatcatcaagcgcgatattgaaattatgtttttttaattcctccagcaaatgggccatttgctttttgttcagggtttcctgtgtctccgtgacctccagctccagctgctgcgggttcaggtcatatttgctgaaaacactccggaattccttaaaaaagttattgtcgaacatggtgatcctggaaaaattaagggacagctggatatcggcaaaccgggttcccttccatttcgtcagcagtttacatacttcgtccataacaaagaaatcaatattggagatcagcccttcactttccagaaaagggatgaacttaaccggagaagaaatagtgccgtctttctccctgcagcgcaccagtacctcggcccggtctattttcccggtcttcatattcagctggggctgcagataaatcatatactgtctgttcgcaatggaatccgtcagttccttaaggagggggattttttcaatggcaatttctttataccctttataatactcctgcttattgatctgcatgatccgctctgccttattcatcaatgccgtcaaatccgcattcacatcactccatgtcgtaccgacagataaaagcgactctccgttcagcgtaaatttcgcttccattgatttaagctgttcactgaattcatcataggaaatcgcttcggtaacaatcaggaattcatcaccgctcagcctgaatttcctcccgttggggaaaaattgcttcatgatttctgaaatatgtgtgatcaccatatccccatatacatggcctctgacggtattcagtttcttcaggccattgatatccataaaaacgacaccaacgggcgcaggcatacgctccgaaaaatcatcgctgtataccatatagctgtttctgttttcaagccctgtcagtgcatcctcaaagctcattttttccaaacgcctgcgcatggaattcttggtgatctcattttcaataaaataagataattcctccagataaaaatagttttccttatttactttgggatcatccattcccagaaagcccttcctctccccttttacataaaggggaagtgccatcaggctctttattccctgctctttcaggagctcatattccagccgtcgatttgaccctaattcttcaatatcgtcaattctgatataatccctgataccgaactgcttcatccagaaggacagtgcttccatcggcacttcctgcagattctgaatctgggggattaccccttttgcacaaacctcataggtattgactcccgcatttttcttttcgtcagcctcaatgatatacacacgatccgcctgataatagtccagaatgattttcaggacatattcgatagaatcctccaggtactcagaggttgtcagccactggatacagtccgcaatacttttctccgctgccagatgcagtttttggcaatccgtatgttcagccgtcttcaccgcatccgtcctgtccgaattccggaaggataccagacaggcatccttccccgaccactttatgggagctgcatgagcggccgtgcatatattctgctgcagggaatccgcacaggccgcattgtcctcgttcagagggcagaagctgcagggatggtctgcataaaaaaaggtctcataacagagcgcgccctcgcggaatctgggcataagctgttttactctgctgttaaaatataatatctcataggtacctcttccgatcacacagactgagccgtcttcctcctctatcaacctccgcagcaaatcctgaagcttctgttcccgttcctgcatttttttcttctgaaggaaggtatccagcagttctgaaatcagcgacagggcattcacttcttcctttgtccacaaacgcatccccgtacattcatcgaaccctataaaaccggcaaacctttccttatcccataaggcatactgtagaaaagaacggattccctgatcttcaaaaagtttcctctgtactggaggcagcagatgggtattccggcagtaataaatagaatcctccccgaacaattcccggtaatcaccagctgtatgataatccaggcgctgaagattttggatttccggctcaatgccttcattacaccattcatatgtatttttataatattttccgacatcatttgtttcaaaaatataagcccggcttacatcaaaccgctttccgaccacctccaaggacaggttgacagcctgctccaaatcctccatattacagaggagtttgaatatataagtgagaagatcgctggaatcccccagagatatgggctgcgactcaatcgcagcgcttatggaggaatatccggtttcctcgggcaggcgggagttcgctgtatcataaaccacgtatccgtctttcccctggcttttcgcctgatataaagcccgatccgcataattgtataatgtcctgaaatctctgccgtcatcaggatataaggcgacgccgatactgcaggtgacatgaatggagcgcttctcattctcaaacaggcggcggaacatttccgtcagatccgcagccttctgcacggccgcttcccgggaggtaatttttttcataaaaataaggaattcatcgcctccgatacggcccaccacatcactttcgcgcatcatttttttcatgccataggccatttccgttaaaacgatgtcccccagcatatggccgtttgtatcattaatctgtttgaaattatccgtgtcaatcataaaaagggcgcagatattttccggtttttcctccagatacgccctgatctgtttttccgtttcatttctgttatataagccagtgagtgcatctcgttcggcccggattttaagatcatccaacgcctgttttctttcttcaatattaaaaataatgcacagggctttcagcggcttttcctgccggccgcacatggcaactccatgaacctgacaccatatatattcctctgcattaaaaattctgaattctgcatttgcatatatactgcccgcgcgcagtttttcaagaagttctgcgtaaacctgcgtatcctccggatggatccatttatgagaagatacctgcgcagcgatctgattatacaccgtttcggtcccgtctttccctttccgattgcaggaataatacagggtatcggaggcgatatcccactcacagatcatgatatgggtatctttcaggccaaactcatgttttcccagaaaggattcgggctcttttgtcagaacggctcccgggttcataccatcgctgctttccgcttttcccacaatgacgccaatcagtttttcagccgacctgctgtcattaataaaccggccgctgtattctacctgcttatagctgccgtccctgcataaaatacggcactcaatggaaaccggttcattgtttaaaaattgtctggcaacctgttccgccacttttgtaaagtcatccggatgtatgatttcagacaggctgttatgaaaccgctcttccagatccggctccataaagcccgtcagtctgaaaaagccttcattcgccccctcaattgttaaggtttcatcgaaatcacaatataatatgcccacaggaagacggcctatcaatgtctgaatcaaagaattgctttgttccaaatgaatgtccatatttactcctcgccgatgcagacccttttcacagtggaaaaagggtctgctttgtatttcgtcaaatatccatccatggaacggtaaagaaattattttcggacagatataatatgattaagtcaatttatcatattatatctgatccaaataccaaaatcaacacaactccgttaagtatcgagtgagggcgaagagaacagtccacgaaagccctgtgtccccggcgtcgtccgatatgcttcccggctgtgatccggctccctcgtcctgccttcccgatccggctgtgtaccctgcaaaggccttttaaaaacgccggtccttagattgcgtcctttgtaatcttagtaccgctgcgtttttaacagagtgaaagtacagtttacaagggactacacagggtaggtatctgacgggaggtgtgccgcccgtcagattttccatgtgatgttcaagctgtcgcttgtggcggctacggtggtaatcatcaaatctaccacacgccgcttatcgtcaaaggatacgctgtcccatgtatcgaggtagccggaaatctgattgacctgttccgggctgatggcttccaccgtcaactcggctatctgcttcacaagttcctgcttgcgcccgtccagttccgctatcttcacattcacataggagagcaggacattgtttgcgcccgtcagactgtccaccagcttttcaatctcgctgtccacatggagaagttccacttgcagggcggcgattttcgggttggcctttgccgctttcttcctgcccgtcagcgtcttgtgcttttccagcttcttcaccatctgctgatagaccaccgcttccagttcggaagtgatgattttcccacagcccggacagcttttattgtccagccgtttcgtacagcggagatattgacggcctacccggttgacgatactcataagcgcatatccgcagttcccgcacttgattttccccgccagccatgtgtgggtggctttccgggcggactggattttcatgttgttcatcagcttcttgcggcacgccagccagatgtcagaggggacaatgccctcatggggagccagcaccagcatttgatctttcaagtcgtttttcttgctggcctttacatcccgtccctgatacagatagcacccgttcattcctgtaaagtcggcggcgtcattgacaatgaccgttccctgacttttgaaaaactcgtacacatccaagtccgcttgcacatagacgggattgcgtaacatctgcgccagcgtggggcgtatcagttctttaccgtagaataaaatcccctgctccgcaaagtagcgggtaatgtccccgtaggaggttgtgggctgggcgtacatctcaaatatcagccggatattggccgcttcgtccgggtttaccaccagcttctttgtgttgataccgtccattttgatcggctctgtatggaagccgtaaggggctttcccgcccatcttaaagccccgctgactgcgggagtagtaagcgtccgtcacccgcttctgtattgtttcccgttcaagctgggcgaacacgatacagatgttcagcatagcccgccccattggagtagaggtatcaaacttttccgtagaggacacaaactccacattgtactgctggaacagttccatcatattggcaaaatccagaatggaacggctgatacggtcaagtttgtaaacaatgacctttgcaatcaagccccgcttaatgtcccgcaccagttcttgaaacttcgggcggtctgtgtttttgccgctgtaccctttgtctgtgtattccttgcagttcccgcctttcaattcgtatttgcaaaactcaatctggctttcaatggaaatgctgtcctttttgtctaccgattgccttgcatagatcgcgtctattctgttattcattttgtcgctccttttcttaaaaaagaaacggagctgctgacacttatattatactgccagcagccccgcaaatcaacgatggcttcggaaaaccttacgccctggcttcctcattctgccgtctgtcggcgtacttgcggaacacctcataaagctgctgttccagttcccggcgtttggccgcttcctgctccggcgtgaacaccggggagaggttttccagcgtgatttctttcccttgaaaagttacgacctctgtttcctttttgtatctgatattacttataaaatcacctttcctttccataatgccgcccccgtttcaactccgccagcacttccggcgggatacgatcaacaagccgctgaatgttgtgcagttcgctttccagctttgcccgttccattgtgcctttcatcttatccttttcgctggctttggctctggcttctaactgctgattttcttccaaaaggtcatttatcgtgactttgtactttttcagttgcccggagaagttctccatctgcggaaaccactttttcagcagggagagggcttcctctttcttcttcccggcgttcagcgggttaatgccgtcaagggcggcttcaatggctctggcctgtttggagagggaaaccgcctgtttgaaaagccgggtggggatatgcttccggcctgtcttgctggcgctttccccacgctccaagtcaggatatttttccaccatataggcgtgaaaatcgtcctgccactttgtcaaattcgcccggttgccgatgatttctttcgcgcacaggcggttgtcctttgtcagcggaacaaaggtcaaatgcaggtggggcgttttctcgtccatgtgtaccaccgccgacacgatattttcccggcctacccgttcgatgaggaagtccgccgcccgctggaaaaacgcctgtatctcctttggggatttccccttaaaaaactccgggctggcagttatcagcgtatcgacaaaccgggtgctgtctttccttgtccgacaccccgcctgttcgatacggttttgaatgaagtggtagtatctgcccttcggcttgacgatatggaagttgtatttactccggcttgtgttaatgtcgggattgctggcgtattgttctttctgtctttcgtgatgggcttccagcggcctcgccgggttgcccttgtgcttctcaaaacgcaaaattgcgtgttgtgccattctgctcctttccccattccattcctttccggcgggttttccacagggaaaatcccgccgaaattatctctgatcggattggaatggaatggatataaataaaatatttttaatctttgtatttctatataccgtccggtttccgtacttcaagaggattgattatcgtacttatcgagtacggttttcagccctccggcgttccaaaaccggatttcttgaagtcggtgtttgaaaccgcttcataggattttgggtaaatacagttgggttttccacagccctgtttcttaatctcaatcaacttcgcatactgtaactcccgcagggtgttgacggctttctgccgcccacagtggagcagttccaccacttcacagatgggatagtacaggtaaatgcgcccgtactcgtccgcccacccgtttttccgggataactctgcccgccgcaggataaaggcgtacaatagctttgcttcgttggacaagggctggaatgtaggtgcttcaaaaaggaaattaggaagccgggtaaagctgaacaccttttccagctgatgaatataaattgtgcttgtcatagcgtgttttgtggacggttagaagcccgttttccggggaagatgatacttgataccacctgccccggtttggggcttgtgaaggcttgtaaatcaaggcttttttcctgtctaactgtccacagcagacctccttttccgttcactttctgttttctgccgcctgtgaactctggcggcgcagtccgggcagtattttccccggttggatttggggacgaacacgccgccgcagaccgcacagcgtttcaagtccctgccccggtaaatctccgcttccagcgtcccggcaagcggcaagaccgcccaccgaaaccatttacagcagaccgagaaagaaaccatctgcggacaggcgcaggcgtccccatcgtcaagggcaatacagttgccgtcctcacagttacagcactcccgccgtatcagggcattggcctgtttcctctgcgctggtgtcatgcggtagggtgtgccgtccggcttgcgctctaatggcggcaggcgtttatatggattttctatcatgtgtccctccgtctgttctccgttgccgttctccccgaaaaagcttcctgccccattcctgcggcgtgttccggcgttggcacgctccccacagcttcgggtcattgtggcccgaagccacctatggacactttgtccagaagtcggctctctgcgtgcttcccccgccggatattccttttcggacggtcattctgttttcaaggtgccgtccatcgatgaactaacctaagtctacacctaaatgaccgcccgtcccgtatatccaagaggtaggaaatccgcccgaaaaactctctatttccacgctctcggaattgtggtagaatggaaaaaacagaacggtaaattggaattattgaggagaagaaagaatggaagataaaaagatattacttgataatattgacaaaattcatacaactgaaatgggagttgatagaattaaaagaaatctaaaaatagatacagtagatgttgttgagtattgcaaaaataaggtgttagataaaaattgcaacatatacaaacaaggaaaaaattggtattgtgaagttgaaaatatcaaaatcactatcaattcatatagttatacaattatcacagcacatattgttaagtaaatcccagtttatagtacgaggaggggggacatggaactatctatacaagaacgtctgaaagacctgcgtgtggagcgcggcctgacgctggaacagcttgcggaacagacccatctttccaagtctgcgctgggaagttatgaagcggacgacttcaaggacatcagccattatgcccttatcaagctggcgaagttttacggcgtgaccgctgactacctgttggggctgtccgaaacaaaaaatcacccaaacaccgatcttgcagacctgcgtttgagtgataatatgattgcgctattgaaaagcaagctggtagataattccctcttgtgcgagttggcaacacacccggattttccccggcttatggccgaccttgaaatctatgtaaaaggcatagcaaccaaacaggtacagagcgcaaacgccattgtggacgctgtgagcgcaagaattatgaaacagcacaatcccggcttgactgacccgcagttacggcagcttatcgccgcccatattgacgatgacagcttttgccgctatgtgatacagcaggacataaacaagatagctcttgacctgcgggaaacacataaggacgattttttcagcgtcccggaggacaacccactggaagattttttgcagactgccgaggaaactgccagcccagacagcgacccggagcaagcggctttggcgtttatctgtaagcgcctcaaattgaatttgaagaagctgtccgaggaagaaaagaagtggctgaaaaagattgcacagaagtcggacttgctgaaaaatccaaccccacagcgggggagaaagtaagagagcgacaaattggaagttgtggagatgatagaatggaatttaacaaactaataccagaattaacagttaaagatataaaaagaacgagggaattttaccttaatatattacaatttaaaattgaatatgaacgagtagaagataagttcatgtttctatcatttgaagattcacagtttatgtttgaagaattacgagatgatggctggaatgttgctgaaatggcatatccttttggtagaggagttaatttttctattgaagtaaatgatattgataaagtatatcaacagcttattcgctctcaatatccgttgtttagagaaatgatgttgaataaatacgaatctaatggagaacttattgaacaaaaagagtttttagtgcaagatccagatggttatttattaagatttacacacgaataatacaaattctaatttatcgaggagatagcaaaaccagccgagccagtcaacggtcaagatgaacggcgcatttcatgcgccgccgttgacagtcccgcccgtctttgctgatgggcaatcaaggcgggaaagccctaaaatggcttccccgcccatttcaatctttagaaaagaaacgctccaaaatcagaaagaaagcggccaagcactttgagggattggccgccttgtccacccattcagtgggacggtgggcggcggtcaaggccgggtgtaaacccgttcatttcagccttgacggttgcccgctgtcctgctacttttccgggagtgtggccacaacttcgggacactttgtccacaagtcggagcgtaggacgagggacgggggctttcatatacgccctgtctgctgatgaaacaagtcctgcgcttgcggcttcacgccacacaatcacagccctgttttcctgccgtttcaaatgcccttgccctccccggcggcaacggcattttcacaacaacgccgacagagcgtataacacactacactttgcaagcaaagtcgtgtgccaaagggacaccctttggaaaccccggacaacaaaacaggctgaatatctcgcacttccccggtgcttgatattcagcctttatttgttgtcagcagcccccgtttcgtggtctgcgtgtagttccttgtaaactgacctaaagcgagtgcaagcactcactacgtgcctgcgcagggtacacagccggatcgggaaggcaggacgagggagccggatcacagccgggaagcatatcggacgacgccggggacacagggctttcgtggactgttctcttctggggattattttattccgcaggcggcatggttttcaggggcgtccatccagaggtaaatatctttgtctttgaaatcgtagacggaaatcatgtagttcagggaaatttcttcggggcagagtttggtgaaaatatcagggtattgtgtgaaggcttctttctggtaatatacggtgcttcgggcggtgtctatggcggcgtagaagatgtcggcttcgacgaggtcctggaacatgtggcttccgaagcttagttcgggcatgtagccggcacggtcgtccgacacctcgcatattccgcagaagccggaaatgtcggcaaaggttgtcgggattccaagctctggggatgaggttcctagtctgcccgggactatcaggagtatgttttggggttctttctggttgttgaagtgtttgttgagctttcctatgattcctgccacttcgggttttcttgcgtaggggtattcaaaataggccttgggatctatgagtactgctccgtccagttttctgcatatggaacgccccatacaggcatcatggatgtcaaaaaagcagttttcttttttgaggagggggactttgattccgccgccttccggccctacataaagcgggcggcattgaaggaggttgagcataaaatcgccgttttctgcgcagttcactgtgtattcaatgtccaccggattgccgtatacctgctgcagtttgcggagcagagccttcatcagctctgtaaatgtctccttttccagcagcttctggcagctgacaaaccatacgtttcttggtctgccgctgtcatacaggcgctgttccgcttcataatcatgctcaaggagcagtcttttcagccattcggggatatccggcagcacctgttccaaatccttttccgccagtgtatttttctccagatccagcacgtctatcttatgctgggaaaagcggtgtttttccgctgtattccgcgccatggttattgtggggcgatccaggttcacgaggcgggggtaatcattttccgtccgatccacagcctttgtgcccagtcccattaccagccggagcatgccctcatccgggcggatatccttctgcagcttataggtgctgtagctgtatcccactcccgcggcgcagggcatatataaatttccataataggagcccgatactctctggaccaggaccgccatctgttcgtcctttccctccagcccgcgctgtctccggtattccagggccgaaatatccattgtgctggcgtatacctgccgtaccgcattttcaaacatggcaagcctttcctccggcatgcccctgttggcgcagaatacggattcatattttcctgcaaaggcattgccgaacccgtcttccaggaagctggaagagcgcacaataataggggtctgtccgaaatagtccagcattgtgcggaactgttcccggatattggaggggaagctccccttaagcagcccttcctggagcctgccggcctcactgaaatatccgtcctccgtgcgctgcgcaatccgcatatcccagcacccgtttgccacaatatacgtataaaaaacgtccgatccgatataaaaggaatcgtgaggttcataataaccctgatatgcaggcagctccttctccgcaatttttcttgccagcagcattccgcaggccttgcctccaatggccccgctgccgatcatacgatcccgcagggcaaaataatccgtacccgtgaaatactttttaatcagctcctgcattttctcgtcccgggtcatcgtgctctctataatctgcgcctccgtttcctcagaaaaacggccttccccatactgcatcttcgccatggtaaaaaaacggtcatggctgtccgcattcagatcctggagtgttgtctctttttcctggcgcaggacgtaatagcgtccgattcccattccgtccgtcaccgcctcgaaccgctgcttttcactgttccatacatggggaagaaacatatttcccgaataccggttccagaccttcaggggatgcaggtacagactgtccctgtctgcgtatacgtccagaaaaagctgcgtcgtatccctgatccgcgccaccgcatcaaaggaatgccttccccgtatcagagggaagaaagccaccgtatccagctgaaacagatagggacaggtcacacggaaaaaattccccatcataagatccgtataccagaccgactgcagttgggaaaggcagtcaaatacataaaaggcctctcttccttcctcccttattctctcatgaatccccaccgtaaagctttcaaatccctgttccggctgaaattcatagattctcagcccttcacagggctccagcacagcttcatgctgcgcaaacctgatataaataagctttttcccgtccttcagcgcctgtgccgcaaacgaacgtgcgaaaaaaaagtattcctccaggtcggaaacctgaaacacaacattatctccaagccggataaaatccagcgcttcatccattcctgcaattccgctcaatatcttgtcaaatgccgccatatccatactcctttattttgcgtatttcatgttaagaaaaaaagacgcagaaaccgatatgatatcgactcctgcgtctgtaatttatcttaaagcaatggctgtcattagtcaagatcaacgtcctgcttccgcctatttcaccagcttatagattgccagtacatcctgccagtacagcttcttaaagccgccgagaggggattcctcaccgaaagctgccccagttgccttctttgccatttcctccagcctgtcctctccgatgccaagctctgcgagtgtgccgggcagccccatcctcttaaagaatgtccgcagccgggcaattccttcctgaacgatggcatcgggatcccggtagctgccttccacacccatcacattgacagcaaactggacgaacatattgatattatctttatatacatactgcatccagccgggtgtcagaacggcaaggcctgcgccgtgcgccacatcataaatggcggaaagctcatgctccataccgtgacatgcccagtcctgctcacgtcccatgcctaccaggccgttatgggccacggtccctgagaagccgagctctgcccaggcatcataattctgcggatcatccagcgcgatcggcgcatttttcatcaatgttttcagagtaacctcgcacagcccgtccgtgagatccgtatgggttgtgttagtgaagtaacgctcgaacacatggctcatcatatccgcaacaccgtttgccagctgatttttggggagtgtgaaaaatagttccggatccataacgctgagcagcggccggataagagggctgccgtaaccgaacttaagctgtttttcttcattggtgataacggaatccccgctggattcacttcccgcagcaggaatcgtaaggactgtagctacgggcagagccttttcaacgggttttccctgttcgtaaacctcccagatatccccgtcgtaataaacgcccatggcgatagcttttgcagagtcaatggtgcttccgccgcctaccgcaaggatgagatccacgttttcctttttgcacagcgcgatcccttcatgcacaagggaaagcctgggattgggcttaacgcctcccagctccgcaaaggaaataccgctttccctcaaggatgcggttaccgtatcatacaggccgctcttctttatgcttccgcttccataatgaagcagaaccttggatgcatggggcttcagaagctccccgattcgtttttcctcaccttttccgaataaaatccgtgcgggtgtatagagatcaaaattcagcatgtaaatatcctcctgatatattaaaatgttgttgtgtcagggtctgaagaatagccgacgcagcccttcagatccgcgatcagctgcacatcggccgcttccagttcaaaatcgaatacctgcgtattttcttttatacgggaaggcgtcaccgacttgggaagaggcagataccctctctgcaggctccagcggatacagatctgggcaatggacttaccgtatttctccgccagcgccttcatttccggtacttcgaagattttgccgacgcccagcggactgtatgcctccagctggatattatgggaacggcagtaatccacaacttcatcctgggtttctccgggacatagcctgatctggtttaccataggagccactgtcgcggttttcatcagctcttcgatatgatggggccggaaattactgattccgatggcgcggatgcggccggccttatacagttcttcaaacgccttccatgtaccggcattcgcctcctgccagtgatcacggaatgctatgggattgggccagtggatcagataaagatcaagataatccatatccagctttttcattgtctcctcaaaggcggcaagagttctctcatagccatgctcgctgttggttaatttagatgtaatgaaaagatccttcctgtcaatgccgcttttctttacggcatgccccacactctcttcattgccgtatccctgcgcggtatcaatgtgacggtatcccgcttcaatcgcgctgagaacagacgatacacagacatccccgtccggggtctgccaggttccgaatccgatgcacgggatttccaccccattggacagcttgtagcaatcggtcagtgaattcatatctttcctccctttctgttgcttgacatatcagttaaaagtcctgtatgatgatcataaaccttagtgttaacgctaagtcaagacttttttcattcacgcgataagttaccaggaggtatccctatgggttatacagtaaaaaaagtggcggaaaaaacaaagctgagtccgaatgctctgaggtattatgaaaaagaaggcctgctgccgaatgtaggccgtacaaaaggcggaatccgcctctattccgatgaggatctggaatggatcggattgatctgctgcctgaaaaatacaggcatgtccataaaacaaatacgggattttgtcaccctgagcctgcaggggcctgagacgctaaaggacagatgtgaaatgctcgtggaacacaaacgggaggtagaggagcatatcgaagaaatgaaccgctatctggaaaaagtcacctgtaaaatttcatactttacacagcagtatgaagattacctcacccaaaatgcggaggaaccgaaagatgactgcgtaaaggaatgacgggcatttttcaatacccgtcattccttcgttcatacatttcatttacccagccttcccgtcggcctttacgcctcgacgggattccactctttctcataatccgcatttctttgcggcatgaccgcacccgtactctctctccagtcatgaagcattttcttcagccgggaagcgatttccggctcttcttcagacacatccctgctttcactgatatcctgttccaaattaaaaagcacggttttcccatcctcgtaaaactcaattaatttgtatttccccagccgtacacttcctcccggagttcccccctgatttccatagtggggataatgccagaaaacaggacgttccggtatttcttttccctgtaaaagcggcaggatactgacgccgtcgcagacttgtccctcccccggcgccaaaccggccacgtccagcaaggtaggataaaaatcaggcgtggtgataggtacggcgcatgaacttcccgccgcaacatgtccgggccaccaaacccatgcaggcaccagggttccgccttcatacatccatccttttccttccgccgccgggaaattacaggtagggcttccctcggaggtacttaacccaccattatcagaggtaaatataacaatagtatctctcccatgcccttcctgctccagggcattccttaaacgtcctatattccagtcaaggttccaaatcatagccgcataattgggatctgactggactattcttcttttcacacattgatccttcttatttatcgtatgaaaatgttccccttctatcagcgcttctgtccgatccaggcgcatgcgggatgctttttcctgaaatttaaggatatcatcgggcttggcctgtatcggattatgcaccgcataatggcagaagttcaggaaaaacggtttgtcatccggagctttccttatcagatcaatcgcttcatcggtcagccgatccgtcagatactctccctccggcccatcctccaatgtggggatatgataagggctgaaataaccgtacgaaggatgtccccattcgcacccgcctatatttacatcaaacccaaagttctcaggaaggtaatttcctccccccaaatgccacttgcccacatgccaggtctgatagcctgcatttctcaatctctccgccaccgtaatcgtattttccggcatatgcttcaaatagggggcgtcaattaatttccctttcagaggatgaaaggtgccgctttcatcaatccaatccgtaactcctatcctcgcgggatactgtcccgacaaaaagcttgccctcgacggtgaacataccggacaggccgcatatgcacagtcgaaccgcatcccttccctgcacatttgatcaatattgggtgtctcatagaatgtacttcctgaacatcccaaatcccgccatcccatgtcatccataaaaataaaaactatatttggctgctgcataaccgatttcctcctctgaattcataaatgtcaggttcctatataatccgtatcgccggatatcccccaaaagttccggccatcattaaattcattgtacctctattccaggcagtccgtccagacaaactgcggacttgttctcaaaaaaataaaaacaggtacagaatcaacaaatagctgcgccgtgcggcagattcgttgcttccgtacctgttttattcctacatccgaagcatgaatttcatacacatccatacatcctgactatttacatacaatcaattccccgtcaaaaggagccagcacaagcctttctgtgaagctttcgcctttaagcacccccttccccggctgttccagcattacttccttcacctttgacgtcgtgttcacatacagcgtttcctcttcggaaatcttacgcaccaccactccctcaggcgcgtcaattccgggactaatcccttcttcttccgctatctgcccatacagccagtccagaagcggttcgctggtttctgccgaagtataataggcctttccttttccgtaccggttcacggatactgcacaggaaccgtcctcctcttcataacaggcataagcctgcgcggaggacagctccagcagctcccagtaagaaacctcgcagatcacctgttgtgttcccttgccatcttccgttccctctgtcatgcattttctgacgcagaggttcttcatcggtgtcttttccccttttgcaggcggatgcaccatggtgcgttcaaaaccggcgacacgcaggccgaatacatcggataaaaggcccggctggaaggtatcaaataccgaattgttttcattcaccttcgccgaatatgccgtcattatggcaatgccgccttcttttacgaaattcctgacattccgggccatctcttccgtcatgatcgcgtggccgggaatcacaaggattttatagttcccggacatattccgtaaatccacaaagttacagtccagatttctgtaatggaataccttgaaggcatccataatctgccttttatagggggtcctgtaataataggtcccgtattcatagaccggcaggttttcataacaataggccagggcgatctccggctgaggaagataagggaagccatactcctcaaggacatgataatccgatgctatctgtgcaaattcatgatattttctgccgcaggttccgtcgtgatccaccaggccaaagaaaaactgctcttctccgcccagcatgcttctccaggtccatgccaggaccatctgtgtccggtaagcaaggcacaggagcgcgtacatccggaggactcccgctttccccgcatagcatccgaaatttccagtctggaactcgatacaccacatgggcttattcagctccgccagtctgtgctcattgatcatcagtgcatatataaatggatcttcatcctccggatcgagatccgggtaaaatcccacgccggggtaatccacaaattcccggcagcccttaagataatcgaatcccagcgtgtctccctcggacacgtgattgctggaatgcatcattccgggagcttcctgctccaccacatccttcagctttatcataaatttcaggacgccgtccccaaaaaatcttctcatctccagataggcttccggagcgccctttgatgtctcgttgcagggaagcaccacatcctcaaagcaattcaggcgtctgctccatctctgtgtgttccatgccttattcagggaatctatatccttatatttttccttcagccagacctggaatctcttgcaggccgcgtcagaataagagataaacccggcgccctgctcgttgcataagccaaacgccatcatggccgggtgatctttatagtggctcaccatttccctggcaaaacgaagtgcataaaactggtaatccggatcatccacatcctccatataacgcgttaccgccgcctgtctgttccctcccggggtaaatatatcacagcccgggcacagcttatgtacccataccggcgccggcctcacggaaacatccaggaagaccttgatcccggcctcataaaagccatccattacctcatcaaaccattggaaattgtaaacgccgtcctgcggctcatagctgtcccagcaaagatgtcccagccgtactacctgaaagcccgcttccttcataagcgcaatatcttttttccagcgctccggcgtccagtcatggggatgataattcgttcccacatataatgccatttatttttcctcctgcattttgcttgttttctgtaatcggtcctttcttttccgtacccgcctagcctttcaccgccccgatcgcaatccctttcacaaaatatttctggacaaagggatagataaccaggatgggcagaatccccaccagcgcaatagccattctaaccgaagcctgggggacgctggccgctatattggacgtatttatctgggaattggggttattggataaatattcaatatttttcagcatattattgagcatctgctgtacactgaacagtttggcatccgtcacataatacagtccgttagtccagtcattccaataggccacaccgatgaataacccgaccgtcgccacaatgggtttggccagtggcagcaccactttccggaatattttgaattctcccgctccgtctatccttgccgcctccagcagggaaatgggaacattgctctgcaaaaaggtgcggaccagaattacattaaaggcattcatcagaagtcccggtattatcagcgcccaaaacgtatttttaatatgaaggtaacgggtatacatgatgtatgtgggtaccagccctccgttaaacagcatggtaaaaaagagaaaaaaggcaaaaaaggttttccccggaaactcgggctgtgaaagggcataggcataaaggacggtcaggcaaaggcccgctgtggtgcctgctgccgtaaccagtatggttatcccgtaggccctgaaaatctgggctctttcattccagatatactgatatgcctccaggctgaattccttcggaaaaaaggaatatccgtacagggtgataaccgtattgcttgtaagggatgacataaccagaagaataaacggaatgaccataaccaaagcttccagtgccattaccacatttgcccctatttgaaatcttaattcatttttacttttcattttcactccattttcctttaaaagaagcggaataaccggtattccgcctcttcctgtcagaacaacgcattctccctgctatattttttggtaatatagttggctgtcataaccagaaggaaacctaccagggactgatagacgcaggccgctgaagacatgctcacatcgcccatattaatcagcccgcggtacacataagtatcaatggtattcgtggcatcaatcaacgctcctgaattcatcggcacctgataaaacaaaccgaagtcggaatagaaaattcgtccgatactcatcagcgtaagagtaatcatggtcggtttgagcagaggaagagtaatatgcctgatctctttccatctggacgccccgtctatggaagccgcttcatacagttcctgatcaattcccaggatggaggccagatagataatagaagaatatccggcccctttccagcagttgacaaaaatcagaatgaatggccagtacttcggttccgaataaaaggctatcggttccatgcccagacctttcagaaagccgttaataaagcctgtctgcccgcttaaaaaagcataggataaatagctgacgattaccatagatatcagataaggaagcagtatcaaagtctggtataccttcacacaccttttattcctgatttcactcagaataatcgcaatcgccactgccgcaactaaattgaccacaataaatgcacagttatatcccagcgtatttcgtgtaatccggaatgcatccggtgttttaaacaaatattcaaaattggacaatcccacccagtcgcttttcaatattcccttggtaaaattcagatccttaaaagctattatcacgccgaacatgggaatataattattgataagcagatacaaaaatcccggaagaagcatgagatagaatgggatatattttctgaaacgtcttttttttactgacaccttccgttccttcctttacttttctgccatccaggcatccgcctgcgcctgcatctcatcaacgattttctgaatgcccgcagccttcagttcctcattaaatttagccaccgtcgtatccggatcattcaggccggcttccgcaatcccctgatatttgtcaatgacattggaaatggctacgatttcattttttactttggagctgtcaaagataaagccgtaaagaggggaaatttcagcggtatcgttatatttctgatactcttcccacacattttccggatcggtctcccacgcatatccgattgccgcgtttccggtaatccaggattcatttgtccagcctaccgtactgcttgtcacgccttccggatagcctgcgataccattttcattcaccacgtaatctttattttcaataccaaaacggaacagattctgcaccttgggattggaataaagaatatccaggaaagcgagtgctttttccggagcttcacaggccaccggcagagtccactggctgaaatccacgccctgtgttgtaaggattctgtccgtaagaggaatcgtaaccatatccataccggtattcatagtctcctgcgtagtcgttccgggatgggaatttccgatatatccaaagcagttccccgctttgatcagatcctgtctcacatccgtaatggtggtggagtccgggatgaaatatccttttttattccactcaaatgccttttgggccagttccatatactcatccgtttcataggtattgacaatatcaatatgtccgtcgttatcattcatgtaaacgcccacacctgactgaatgatatcgaaaacccctctatttatattggcaagcgggcctctctttggttctgagctgaccagaagggacatttcgggatgaagttcctttacctttttaagaagctcctccacgtcatccagtgtttttatctgtgcggcgtccatcccggtttcttccagaatatcctttctgcacacaagtcctgcctgcgacgccaaatcgcggaaggtaggaacaccgtacagctcatctcccacataacatgcatcgatgtatttccccatcgcatcctgcatgtcttttccgtaagtatccatcatccctgttatgggaatcagctgtcctttattgacataatcctttgttccggaataggaaaagaacaaatccattttctcaccgctggaaagcatcagattggtctgatccgtataggttccccattccagtacattcagacggataaccgcatccatggtcttgctcacttcttcattaatcgcagcttccacctccgccaggctggccggtgccgaacttatgccgggaaaggtcaccagaatttctgtcatttccccatcttttaatacgggatcccccgcttccgcgttttcctgaactgccgtgctctccgatgcttcattcgttccttccgccggagccgtttccgtgcctgcgctgtttccgcatgctcctaataccaaagccgcactgagcaccaaagctgtaatacttactctctttttcatgatatccctcctgcccgctctcacgagccgcaaatctcagttacaccataagttacttacaaaggcctttgtttgattatagtataacggccggccgtttctgtcacaagaacaaaaccgaccggccgtgtaacgatcccgacttcttcccaacttacgtgcagcgcccgctctcgctcaggctgctgcggtattccgccggggtgatccccgtacatttcttaaagatcttggaaaaataaggaggggattcataacctaccaggccgcctatttcactgatcgatttctgcatatccgcaagatattccttggctttcagtatgcggaaatgctgtacgtattccatgagcgtatacccggttgcacatttgaagctcctgttcaggtaatcctggttcatatgcaccagctcctccacatccttccggttaatagattcgttataatgctgctccagatactcgcggaggctgcggatgagttcattccccgcaccgctcctgccgtttccggacagtgcctcttccattatgctgcccgtccacggatccccataataaatcctctgccccttccggaagtactgccgggacacctccttcagcatccggtaccgctgcgccgcttcctccagccgcagatccttcgtatagtaggcatacagctcatatttcagatatctcgacacctttcccagaaaaacccgggacatttcctcaatatcctccttctgtttccctttcttcaccagccatatcatatccccgttatactccagcataacggtctccggaaacagctcctccgcaatattttccaatgcgaaataaaaaaccgagcctttatccgccttgctttccttccccgttaaaggcagcagaacgagattgtccagttccagatcttctttctgcattcctctgcggacaatttctttatccatataatcggcaaagggaagaatctcttcggaaagcaggtcacgatagaaaattttctccgtttttccgcggttttcctcatagtattctccatatcttctctgctcttcccgtttctgttcctccctgatattctgtacggcctcttccaccaccgctttcagttctttgaaaactatcggtttgagaaggaatttgaataccccgatggaaatagcgtctttggcatagttaaagtcagggaagcccgtcagtatgatattcacgatatccggatactcctcctgaacccatgtaaggaacgaaatcccgttctcctggggcatttctatatcactgattattatctgtatcgattcctgcgttacaatccgtttcgcttcctgggcattgtaggctgtaaagacctcgtttattccaagctcctcccagcagaccgcttttttcaggatctgaatcacagccacttcatcatccaccagtaaaatattcaccctgctattcctcccttctttccggaatccggatatatatggccgccccctgttcccggttccgtattttgattccggcccttccatgatataaaagcttcagcctgttcttgatattcacaatacctataggctgcccattttcttcgatatcttcccccgcttccagcttacgcagcatttcctgccggaatcccacgccggtgtccgagattaaaaaaacaaggctccccggatattttctgacaacaatatgaagggtaagcctgggaaccagggtgatattatgcttgattccattttctataaaggtctggagcagcagcggaggaacccactcctcttttcgctccgcatcgcattccaaagaaaaatccaggcattccggataacgcatctgctggattttaatataatcctcaacacagccaatttcctgctccagcctcacaaaatcctttttggtgctgagcaggtagcggaaatatctggacatatataccgccagctcctgtattcctttataatcccgtatttcagccagtccatagatcagattcaggatattggtatataaatgcggctggatctggacacgcagataactgctctggatgcgctgtttatccagcatgttctcgtagacatcaattttcagcttcattatctgctccgccatatggttaaaggtttcatacagcaccttgatttcattattgcgcggatattctctcaggcgaacctccgtcctgccttcactgaaggcttccatggcgtctttcaggctgttcagaggattgaaaaccacctttctctgaaactggataacccccaggataatgatgcagccgataaggatggcgcataccgtcagcatccacagataatcccgctcactgtaaagcctgttctgggacacgatggctcccaggctgtaatcggtctgcacgagatcgttcttgaacaggatctctgaggaataatccatatccttccccatccttgttacgacattcccttctctgtccagaaccgcaacagcctcggcggccttactgccgctcatcatatcctccagtataatattacactccacataggcccccacatatccgttaaacatgcggtatacctgtaaaaagtaatattttcctccgctttccataagactccagctattattgttgcggattcctcccgcatcgatataatcctttacggtcttttcattttccaggttttccacataattccccgaatgtcctgtggaacggagaaatattcctctatccggaacatacgaaaaaatacacatctgatttccatgcatacttacaatatcaatcagcttgtccagcaattctattttgcttgtttccaccagaagactgtcgtttgactcgcatatattatagaaggcttccccgccttcatagctaattatggaaagcatggaattattgatggttttcagtttatccgcccagaatccgctgtacagttccagggaattctggtacatttcttccgcccgctgccggtactgtttgagcacataaaaattggacatctccataaggaatataattaccattaatgcgatcagaatagaaagaagcactttcgtgtagatcgactttctgtaatccaatgtgagccttttaaaaatacccataactctccctcttttccttataaagcatttcccttttcatatgcaccccgcaataaatccgaaatatccctttttaattttattttattataattgaaaaagacaaggttaaaaacgacttcttctgtaacaatcccgaccagattattctacccataaccagtccttctcagtatctgattatacaggaatggcattataaattccctgaaataaataaaaaaagagatgacaacggtgatatggcactccagaaacaaatccggtaaataaccaaatccatttcagaggcgtcataacgaccgcaaatcatctctttttcaatatcattatttcatttttcgggaaccgcagcattgctgccggaaccacacccgttatcagggctttaagaccgtatccagcacctgggcctgaatcctggccagataatcattcggatggttcaggaggtttcctgtcagatcgatatatctttttcttttcatcacttcccgctgcaccccctgtacatccgcaagtaccacgccctgtccgcacaaaagccgcaggcttctggcatactcatgctgatgggcacagaaataatggggttccgtttccgacaggggattcggcaggctggtggcaatcaggacaaattccgtttccggcgccttctcacagatacgctccatcagacgctttgtctttttccggtattcttcccccgtgcatctgtcgttcatgccgaagcccagcagaaccagatccggctgataagaagcggctctttcccatgcattctctatcgcccactcggtatccactcctcctacggaggtgtttataaattcaatgggcacgccgtaaaaatcctgcaggctttccatcaaaagctcagaccactgaggctgcttcggctccaggccgtacagtccgctgcagtcacagccgcaggaaatgctgtcgccgtaaaggacaatgcgtaccttttctttccgcttccatttcccatacaaacggggaagccgggctatccgggaaaccgggcggtatcctgtccacttttcttttgtctcataggtaactgccgcctgccagcgggtaatcatttccggattgcctatggcattcaggttcaggaacttcccgtccgtcgtcgctaccggcccgaaatccagttccatggcgttgcttttctgcccttcctttgcttcttcgaaggaatcataatagaaactgtcccatccggtatggggaatacggctgtcctgcgtgagaaccagccgcccgtcctccacatagcaatcttttcctaaatcaaaggtactggacttatcatagctttctatcgtaatcactttttccggttccagaagaaaaggggcgctgcaaggctccccgtctcccaccatggcaaaggtttccctgaaaacctgcccgccttcccataccggtctcaataacatatttttatccgtcatttcgtccgtccctttcttttcattccagacagaaggaagccagactcgcgccaccatctccctgataaacaaagtacagagcctgcacgccgtccggaatggcaattgcagcaccatattccttccactcgttggaaaattccacaggaatccagcccagtaccgggccgtcccatgctgtttttactccaaaagcccctttacagtaaccgcgcactcttatggatacccggcttattcccttgcatgcaaaatacttaaagcctgcatgggctccgttcctcatgttggcgatatatcctgtttcctcatcaccgtccctgccgtcctgggtgatcttggggaaccggcagtccatccattctcccggtgctcccgtcgtaaacgcttcgtctcctgtaaacaaatggcaggcaagatatgccgggtactcccctttgccttccaaaggacctccgttggctccgcaggaggttatttccgcctgaacaatacttccgtcttcacggaaagaaatcggttcgatgcagccctgcctgctgaaattggtcccgtccgtatgcctgtgatagaaaatataccattttccccggatttccacgatactgccatgattattcccgccatagctcataggcttttcagccggcttataggtatccatatgacagtcattgttgctgacaatcacgcccccatacacaaaatccttcataggagacttactggtggcatagcacaactcaaccatggcaactgaagaataaataaaataataggtgtcaccttttttccggatggacggggcttcaaaaaattcatggccttcaaagctgcttcccttgctgtacggctggctgggcgcaatatttaccgggccttcctttatagttagcatatccgggccgagcactgttcccatagggccgcttctggatttgtcgccaatcgcacagaagcccgtataaagatatgtattctctccttctgtcatcacgcccggatcaaactgtggttcatccccttctttttctcccagacgtgtaccgtccgcataatggacatatccatagaattcatattcgcctgccggcgtatcgcacaccgccacggataccacaggtaccttatccaggacataatagagatagtatctgccgtccggccccaccgtcacgtccggtgcatacagacacatatagccgtccggattcagcggatcctgcgttttccggtaaatcactccttcataacgccaatcccccaaatcatccgccggagcggaccagcatacataatcattcagacagtatgcatggccgcggaaacggtcatgggagccataaatatagactctgtcattgaatacataaggttctccgtcagggatatattcccaggacggaagataaggattatatgcttgttttttcatacttttgctgtaccttcccttccaaagcccggctgacaaacggacagacacaggccctttttatttcttattttttcatatacctttggggaaagcaatgacttatccttatgaaaaaattgatttattatcatattgtgccggaatgataataaatcaattttttctgtgtcccggagaactgctgtaattcttcccttattccactaccacacgtactctgtccagattccggcactgtacaaatatatcgtccagcttcccatccctgctgctctgtgccttcagcacagggaaataggttcccggcttttcaaacacatgcgtcgtttttacatatgcgatacgtccatcctcctcttttaacagctcttcatatctgctgaaatcatccgtcctttcataatcccacgctgccgccgtcacccttccggccataggcggcacctctattctggcggtaaaggaaaccggctccccggcttttacggtaatgcttttttccccattcgcccttgcatccaccacaggctgaaggccgccactctctccggcggttgccggcacctttatctgtccgtcctccagacggtagctggtagtgggcaggggagcgattcctttttcacaccagtccgccagatccaacagggcctgatgaagaacccccagataatctacctgatgctgtttatcgtccaggtaaccggctctgtcatcatggatacagtggtcattataatacagtcggaaccagttttcctcatccccgtcctttgcctttctcaccgcgttccggtaccagtctccatgccatgccagcgcactttcatccaaaatgctgcagaccgtaatcacttttccgttgatccccccgtcagggacgctccctccgccattctgcgcgatcagaggcgcaatcagcacaggaagctggggataaagagggtttccgtccgcatcacggtactgatcatatacccggtagctcccatcgggaacctgatggcgctgaagagtctgcatcgccagataatcgctgttgtcaatcattatctgatccccttccgccagacctgccagggaatccgttccgttgctgccgtcataggcgctgctcacggtaagaagatctccttccattttatcaatcggacattcctttccctttgccttaccgctcataacgcggatacggctgtgataaagacaggcatcctcagcgggaagctccgacagccggattaccggagtctcattgttgccgattaacgtattcagccagctgttgtccacactgttatatatctcatcctccgatttcttttctttgtaaatcagttcttttaccactgtgacaaactgaaccctatcctttgcttccgtgctgtccggatccgaacccgcaaagccgggcttcgtccaaaaatccgtgaaatactgcggatatatctgataaatcatgggagcaaggaccatcagagctccgtctcccataaagggccagctgaaccatcccctttcagggaatcccattctcgtggcctccctcagcacttcctgctgctgtggagtcaagccttcgtaaatatccccgcttccgcccggctccatggcatccactaccttttccagcccctccctgcccaatacacgcatcacccgtactctcgggcagaatacattcggagtcgccataggattcgccagcacataaggtacaccgccgtcccacacaccttccgtcatttccatacagctcatggttttaaagctgccgccgcttcccccaaaaatatacccgtacggccgatgctcataaccatagattctctgagccgtcttacggccgaactgcgcgccgttggcgctggacttataaagccgttctcctcccgtcagcgtaaagccaccctgattcgtgaccacatagtaagccccatgagtcagggcaaaactgattttgtcgtcttcccccgtcagagactcgctcatatgctcatcctccggcgctggcgaaacatattgaaaaaaacgtccttcatacttttccttttccgggaaatacaggcagaacttcacctgtgtccccccttcctctgttccgagaaagcccccatgtacaaaataatgtctgaccggcttctctctccattcttccacgtcaatatagggacgggagaaataaggatcctcctctggaacatatatttttttttcctgcatcgttattatccctcctgctgtcctgttgtcttttctgctattgcttttcttcgttcctcattatctgtttttatctgcggcatcagcttatccagcttgtagagaagaaggcttgcggctaccaccacccacaaaaccgcggggactatgctgaataaagaacgtatcatcatgacggcactgtccggaatcaaagacatatctcccacatagccggatgccgacagcaatacgcccaggacgcctgcacctatggaagaaccgattttggtcgcaaaaccggtcacacatcccagggtcccctccatccgctgcattcccttccattcattgaagctggcgcattcaataatcaacagattaatcagcatggaaatcggtacacttcccactccatagcagaccgcggcaatccccagaagaaccatgtttcctcccgcaaaaaagttaatcgcatatccgaatgcactgacaaaacagcctacaaacatcagctttgccgtagaaaatctttttataacagccggaaaaataatgactgccggtattccaatcatctgtatcgcgctgataattcccatctttgatacatccctggcaacataagtgaaataataaacattcacccccatattcattacgaaattagacacaaacataatcagagccacaatatagatgtacggattcctggtaagaacttttttcacatcacggaaattgaccttttctttctctccattttcgtcaaccacatccacatctactgtttcctttacaaaaaagaaacgcatcagcccgattatggtcagcggtatggcaaacatagccatcagcatgctccatccggaagcacttgtcgcaaacctggacatacagatgggaaatgcaatattaaatgcgaccgtccccagcatgcttatgatgctgccataggaattgattgccacaaactgctcctcatagcgaaaggccctcaccatatataccgtattattcgcattcagaaacgtgtaaaaaatactgtttaccaaagcatacatacacagaatccatgcgcttttaacaaccgtgctccactggggagaacaggaaaacatcagccatgtgcaaaaccagacacccactatgcacaattcgtacggccgtcccctcccccatttcgtattggttttatccacaagatagcctgcgacaatatccgtaaacccgtccagcagcttgctgaccacgagaagcgttcccaccagcgcaggattcatcttcagcgtatccgtacaatagacggacaaaaaaccgattgccatcagggcacagccctgggatatcgcccggctctgccatgcgagcatgcgtcccgctcccactgccttaggattcttttcccttttccccataattcccttacctcctgtcagttgttacttcctgttaacaatgatttatattggcatcatagactattttttctgttatttatatcaatatatttatttttatgttattatatttacaaaagttatcaggaggctttatggatctggattattttctcgatcaatattatcaggcgacacatataccggtcagtttttttcaggacagggcacttgtgagcaaatcttctttatccctgcaggatttcaatcttcccctgattctgctcaacggcctgtctgatccgcttccggaattatggtacagctatacctctgagtatctctatttcggaggatttaccgtagaagaagaaaacggaatcctgtttgtcggtcccgtacttccatccgaatgccttccccgtcaggcggaaacaatactccgcaggctcggacgctcttcgaaggactcggcttccctgcgggcctattttgccgggaatatatcctgtgatctttccgccttactggctcatctgcgttttcttcaatatgccttcaacagaaaaaaagaagccgatattgccaggcttccttttacatggaatattccttatcccgttttagaggatatacccatcgaattaaggcagtccattgaccctgccgattcatggggagaacgtacgctgatttcctatctgcgctatggccggctggatgatatggaaaggctgctggatgaagaatttgtacattcagagaactggaacacgattccaatcgaatatatgcgcagctatgtactaagcgccaatgttatggcatcccggaccgcctgtcagtcaggtgttgattttaaccttgcaaatgggattgcatcccattatctggataaaattctccgggccaggacaaaatcggaattatcttatttattttatgactttttccgggactatacccggcgcgtagcccgtatacagcagctcagttctccttccaaaaccgtacggctgattaaccagtacatccagtcccatttatatgaaaaaataaccccaaccatcattgcggagaacctgcacggaaactgttcctatctgtgcacgcactttcgaaaggaaacgggaagaaccatttctgtttatatccaggaatgcaaaattaaagaagcggaacgtcttctgagttataaagatttttcgatcgtaacgatcggggaaatgcttggtttttcatcacaaagctatttctgcagtgtatttaaaaagattaccggcaagacaccaaaggaatacagagcggaatcattttgctgattccgctctgtatccggccttatcgatatcatattccaatgaatctcagaatccctgttcttcaagccattccgccgccaaaggcgcccagcgtgatgtgtgcttaaacaaaggggtttcatcctctccgttatacagtgcgcctccgtgaggcccttcgccaaaagtatgcagctcataaggaacgccccttcctgccagctcatagcaaaaaagcaatgcatgccggggatcatccttgtgcgtctgaaaaacaaacataggcggacagtccgaatgaatattcctgacgggatcatacttacaccgctctgcctgctccttaaagtcaaaagcaaacataccggaatcctttataccgctgtcagacatagctccataaaggattaaagcggcatccggccttgaggaaacacgttccgcagcatccacagcctgcgggttcccatacgaaaactgtgtggctgcataagcggaaagcatgccgccggccgaaaatccgccgatagcaatcttatccggacagatccccagctcatccgcatgcagacgcaggtaccggatcgccgccagtccgtcctcaccggcgctgatcctcacatccagcctgtcactatccttctgcttcgcgggatccacatggtaatcgagaatagccacattaatacccgccctgtaaaaatactctgccaccggttttgcttcatttgaagatttgaacagaaaggcacccccggcgcacacaataaaaatccctctccttttcccctcatgaaccggtttaagcgccagacgggatgtaaatcccatatccgtgcgaagctctgtaatcacccatccttcttcctttatttcttccatcatatcagcccatttagccgttttcacttcagtcagtgacgtccagtcctgatccacataatccggtttatccatttttccgcccatccctttcctttttctgtcatcatactgattctattatctgccatacagacagaataagcaacttctttcctaggcttccgactttcttttatggctgacgaagatacgaaatacagcacagctgtgggccgtaacaggcacaatacagaaaaccgtgtattatcaaaatataatttactatttatgaaatgtatggtacgttttattaacaaggattttttatcagtcattaattaaagctgtatctgtccgcccgggagaaaacgtacccagaagggaattacagtggtaaaacatatatagaagggaattgcaatggaacaatttgatgctctgatcaaaaaggacgattcaggcagactgacaatcgtcgaagttccgttcgacgcaagaacggtattcaataaacccaagggaaccatttatgtaagcggtacgatcaatgacaacgcgtaccgaagtaaattactgtcccggggaggcggaaaatttattatgattttggataaagccatgcagaagtccgtggggtttgacgggcaggcaatgactgcgaatatcacgatgtatgccgaagctctgcagcctgtccggaatgttcctgaaaagcctgcagaaatcacgtgtggcatggatgtgcttaccgcgataaaaacgcggcagagtatacgaaaattctactccaaaccagtcagccaggatatggtaaatacggttctctgtgcaggcatgtgtgccccaaccgctaaaaataagcgtccgtatcattttatcgtggtaagggacagacatatgctttcagtcctggcccggcataattcaaatgctgccatgctggaatccgcctccggagcgattgtcgtatgcggagataaaaacagggaggggttaaaagagttcctgtatgcagattgcgccgctgccacacaaaacatactgctcagtattcatggcttagggcttggaggcgtttggtgcggcgtagcatccaattctgaatggcggaaacttctgattgagcagttaacacttcccaataaactggaacccatttctgtgattggttttgggtggcctgatgagggaaaggaattaaattcccgatgggatacggcaatggttcattatgaaaagtggtagcaggcataatcaattataataataggacggcagtaataaccgccgtcctattattatagtatataaagttcccataaaataactttacctgttcaaatggattatatcagcctttccttttatcccttcgcctgtaacgctccataatttaattgtcgcactgttttcaccagttttagtgaccacaattatatccttaaatccgaatgcatctatattaaatacaagttgaacagaagatttcgatattttcgccgcactgcctacacggccggattctctcgtgaaagtcccgtccagcatcatggaatcatccgtaatcttcgtaaaggtaacattcttccaataacttccatctcctgaccagtttccgttcagccatgaagttaactctcccaaactgacagaactttctgctgccgctgcttttttctcagcttcctgctgttcttgtatcttttttattttatccagatattccgtactgtctttataatcttttatagaattaaactctttaaatgcttccgcataatttttagaagaccaatactccagtcctgccttatattttgactcatagcacttaacggtcaattcctttatcgactcattatccggatccattcctgacaatatttccagtgccgaatcccagcttccattttcataatattcatatgcctgtttataagcatcagttaattcaatatgttccgctaaaagctcagcaagacatatttctgaattcctgtactcccctaactccataaacaattccctggctgactcagcatgaacctctgttttactatacagacaggcgatttgatatttgcattccaataatttttcttcacactccatatcatccgccaggctgttatagatatcctgtgcatccaagtaatcctgtacggtttcagcgttttccagcataaacccagccatatcaaattttgttttttgaatcatatcttcgcacgcttttctgtcttttatggagtccagcaatgacagcgcttcttcatactcttccgtactttccgcgttttcctttattctcaatgccttccgatatatggtttcaaccgtctgctgagggctgtccttgaagtctcccagggcggaaaatccttctattgctgcgtcatattgtccggattccatctgttttactgcttccgcataatgcatattgggtattactatttttacagcaagcacaccagccgccaaacagataataaacgcaccagacagtcctgcaatcattttattctttttatttctttctgacttttgctgcgtctgccattcccgcattttttcatccagatatttttcagaactgatctctgccagcttacgcttttcagcccgacattttatacactcaccggctgtgtccggattcatagtaccgcatgcacaataccaatatccatcgcttatataaggtctgacaatgccttccgtctgaaagcccgaaaacattaattcttttttaaactgttccgcatatattccaaaggaattgatatcctgagggccttttattccgataagtctatattcctctgtatttaatgtttcatcttcatatatgacattcgttaccgtaaaaacaaaggttcttacattctcatcattcaggataatcggttctctgtccccgaaaacttctcccggttttatgctcaaatcgttaaaagtatgttccaatgtatccacacatttttttgtccaatccaggcagtcaattcttactatgaccgccctgattgttctaatatccacactggcaaactgcagctgcaatacattttttcctgtcgatgtgtctcttaacaatgctcccttattgaacattacaggagatccggatacccactgtttctcccgcagatatacaatattttggtatctgcccatatcatattcctccactcacagcggcgggagttcctcttgcggctcactgctgccttccatccgtattttcttattattctcatctattacaataagtaaaaaaccggctgccatacatacaattcctgaaataaggaagcctgcggccaatacaaagtaggcagctgcatatgttccattaataatatagttataggcatctcctccgacataagcatttttattcagcatgctgtaatcagaattataataatttgttattttatcatatcctttatatgtcatgatcccaaataaaataataaatactgccgccaaacaaaataaaacctttccaaaatactttttcatttttcctcccgttcccgcatttctgcacattgccaatctgtcagcctttccaccccgttaagccgccagagccaacagccaatggagattaaaccctatcaagaccatctgtttttccggcttcttttaaatcaccggtatctccagtatagatcagagaaaaagattttccaatagctgataccaatttctgttaccggaatatcacaccgttttcccgcctgggaatgcggcaaaaaattgttccgacatataaataaaatctttcatattattagacagccatttatctttatggtaaatcagctgtatggaaatatcacaattcggactgtatggaattttaaccaacctgccgctttccatttcctcttttaccgtaaattcaggaagcacacataaccccaggccgctcatcgcactttccttaataacctgaatgctgcttgtctcaagtacgatattcggaaaaacggaatgttccgtcatttcccgttcaaacatcccccggtaacagcagccataaccggtaaaaatgaaagataccccggaaaaatcccggatctccactctttttttctgagtgaggaaatggcccggaggcgcaaaaatacatatcggttcttccatctccatcaccgtgacaattgacggatccgagatatgcttatcaatagtaaaagcgatatctatggaatgattggcaagcaaggccgcaaattccgaagaatctgcaatatccaaatgtaaatccgtatcagggtgagtttctttatacttcttaataattcccggcagtatataaattcctatcgattccgaagcgccaatcatcaggcgtccgccgttttttgtgtcagcatacatattctctatatccagtgacattgcagtcagcctctgtgcataaggaaccagctgctccccctccggagtcaaggaaacagatttcccgattctttcaaacagccgtacatgtaaatcttcttccaatctttgaatttgtgctgtaacactcgattgggcatagtctaaatattgggctgtttttgtaaaattttttaatctgctcaatactaaaaatgtatttaagtgtttaagttccattttatttcctctcaccgtctctcagcgcaatacctatcgtaaaatccgattgatacaatccaaactatcaattattcagattcttccttttatgttatcattagctataaaaattagcaagggggatactcttatgttgactaaagtaaatgtggtaaacgaagtaaacgcactcgggcagctgtttgtttataaaaaaattgctcggctgaacgaacatgtcttaagcgttgtacaggttgaaaatcggacattagactttcatgtccatgacctttcggatgaactgttttatgtaatcgagggaagttttgaactggaaacaaaggaaggcctgacaaaggttaatcagggagaatttattattgttccgcgcaataccccccacaggcctgttgtgggaaagctgacaaagtttttgatgattgaactggaaggaacccttaataaagaaaatagcggagatttgtatgaagattagaaaggatattgttcctgcatggcagcctgttctgtaattcctataaataaccagaatgaacaccgggaaaaataaactcaagaaaccggtataatgcaacagaatggcaccatagctctattcataaggctatggcgccaactaaatgtcatatagacaatattataacattagagtatctgttaaatcatatatcataccggatctaccacctattccatttgcttgtgcaccggcctcacatacttccagaaccgctccggatcgtgataaaagtacagtatcctgcccggggaagtatcataagaataaccggtgccggtaaagtcaaagaccgccattgcttcttcaatcttttcttccacactgcgattttcctgctcataatcaaacggtccatgttcaaagacaagatactccgcttccggaacatcaagcatgatcatttggggcggtacttctccattataatcggcaggaagacgtacgccataacactccgtacgcggaatcccccagtcgcagagccggccctcggggtcaaacatatatgccataatctggccgctgctgctgttggattcaattccgccatcgtcatccaatttgcccttgatgctgtcgagcaatccgcatatggtatcacagtcctgccccggaataagactctgtttttgccagaaatcccaatacccattgctttcataatttttaatatgcaaaaatttatgcgcagggatagttacaaaatagaccttaatttcatctgttgatttcatcatgccaatctctccaaatcctaataagtagcggtcgaaggtgttgatttttgtacgaaggacgacaggcctgggctctcttcgatattcactcggtgttacaccatatgttctcttaaaggctctggtaaaagcttcatgtgatgaaaatccataatcaaaagcaatatcaagaaaacttttttcactgtcccgcacctctttcagcgcaaaggccaatcttctgagccgaagataatctctgaactgcatacctgatatttccctgaattttcttgttgtataaaattcggaataacccagtctgcgggaaagggactgcagtgtcaatgcttcatcattatagtttttaatacacttgtcaatttcatcaatgaaaatttgaatttgcttctgccactcgtacaatgctgtttacctcgtttcgaccaccctgtattcattatagagaaacggaaaagctgccgcttgatttcacttgctaaaaaaggaaccggaacatacggccaaacggctgtatattccggttcttctttcaatcacaatatattatctcactgacacgcagttaagaaaataattttgttaattaaatctgagggcctgcagaaactaatgcttttcctgcttcattaccttcatattttgcaaagttcttcacaaaacgctgtgccagatcttttgctttggtctcccaatcagcaacatctgcataggtatcgcgaggatcaaggatcttaggatctacgccgggaagttctgtagggatttcaaaatcaaagtaaggcagcttctttgtaggagcttttgcaatggaaccatcaaggattgcatcgatgataccacgtgtgtcacggatagaaattctctttccggaaccattccatcctgtgttaacaagatatgcctttgcaccgctcatctgcattctcttaacaagttcctctgcatacttggtaggatgcagttccaggaaagcctgtccgaagcaagcggagaaggtaggtgtaggctctgtgattccacgctctgtaccagccagttttgcagtaaatccggacaggaaatagtactgtgtctgttcgggagtcaaaatggatacaggaggaagaacgccgaatgcatctgcagacaggaagataacatccttagctgccggagctgttgatacagggcgaacgatgttttcaatatggttgatcggataagatacacgagtattctcggttacgctcttatcatcaaaatcaatctttccatcagcatcaactgtaacattctcaagaagagcgtcacgtctgattgctttgtagatatcaggctcagattctttatcaaggttgataaccttagcatagcatccgccttcaaagttaaacacacccttgtcatcccagccgtgctcatcatcaccgataagaagacgcttaggatctgttgacagtgtggtctttccggttcctgaaagtccgaagaaaatcgcagtattctcaccgttcatatcggtgtttgcagaacagtgcatggaagcgatacccttcagcggcaggtagtagttcatcatagagaacatacccttcttcatttctccgccgtaccaggtatttacgataacctgctcacggctggtgatattgaacattacagccgtctcagagttcagacctaattctttgtagttctcaacttttgccttggaagcgttgtatacaacgaaatccggctcaaagttttccagttcttcagctgtaggctggatgaacatgttggtaacgaaatgtgcctgccatgcaacttcaacgatgaaacgaattgccatacgggtatctttattagcaccgcagaacgcatctacaacgaaaagtcttttgtcggacagctctttcagagcgatatccttaactgtgctccatgcttcctggcttgccggatgattatcattcttatactcatcagaagtccaccatacggtatccttcgaattctcatccatgacaatgtatttatctttaggggaacgtcctgtgtaaatacctgtcataacattaacagcaccaagttcgcttacctgacctttttcaaagccctcgagacccggttttgtctcttcttcaaacatacagtcataggaagggttatgtactatttctttaaccccggtgataccatattgactcaaatcaatatttgccatctcttaataacctctctttctttttgtcgatttcagtttattgtctcactttagtaataataagtcaatatccatcctttcaaaattcgcatcaaacttttgaataaatatatcaatttttccctgaataaccgcggtttccggcatttgccgataacgggcctccgactgcgattccggagctaattcatgagcccggctgtctccgtattttccaaattattgttctcatataacgctgtattgaaaacgtttggagcagcttatttaacaaccgattattccctgtctgcattacctaatgatttctgctttattttctttaacaggcagactgtttccacattcccggtccacgggaactggtccaccgccaccgccttctccaccacatacccattgcccagcagcacttccaaatccctcgccaggctggtaggcttacaggatatatacaccatcctgtccactccatacttgataatcttctgaagagccctgggatgaattccgtccctgggcggatccagtataataaaatcaggcttctcctcaatttcatccagaaccttcagcacatctcccgcaatgaattcacagttatccagcccgttcagcatggcgttcttctttgcagcttccaccgcttcctccacgatttccacgccgatcaccttcttcgcaacgggtgccataagctgggcgatggttcctgttccgctgtataaatcataaaccacgcagtcttccttatccagattacctatatattccctggccgtctgatataatacctccgcaccatagctgtttgtctggaaaaaggagaatacggataccttgaatttcaaacccagcaattcttcatagaaataatcctgtccatacagaacagaagtgcggtcacttctcaccacatccgccaccgaatcattttcaatatgaaggatccctgctatttttccctgcagaggaagtgccagcagcatatcccggaaaggagccagatctctttctacctgggttgtagtcacaagtgcaatcaggatttcacccgtatgggaagcctttcttaccaacagatgacgcagataccccacatgagtaagcctgtggaaaaagggagccttaacttctgtaaaataagccagggttccctgcaggatctgtctgtaatcctcatccactatgcggcagtccttcacggaaacaatatcataaaagctccctctcttgtgcattcccaaagccagggggccgtcctttacctcatccccgaaggaaaattccattttattccggtacccaaactgcaccggactggctttgatgggttcaaactcccaggactgttcctgtctgaaaagcacactgtccagcagctccttcacctgtttttctttcaggctgagctgtttttcatagggcagggccaggtatgtacagccgccgcagtttccgaaatgggggcagggagcctgaatctcatcgggtgaaggcgcaagaacctgcagcacccttccttccccttttcccttccttacctttgttatcataagggataaatgctgtctggggagtacatttttcaccgtacagaattcttccttttcttccgcctgtatacagattctttcctccgtgccgttttccttcatactgctctttgcttccgcatcagcagacgcaggcatcagcttcacattccccttattaggaaacttaacatccattacaattccatctctgatctgtccttttttcatatcgccctctcatttattggatctgttaattaaaagacctgaaaaacgggatgcctcagcatcccgtcttctgttgatacttttattcttcacttgtttcatcatcggatgtcgtgtcgtcatcggatgccttggcattgtcttctgttgtatcggcgccttcttcatcctcatcttcaaaaaattcatcgtcgaaatcatcatcgaaatcgtcatcaaaatcttccagataatcaggcgtaagataacggtacaccgcataagcaattcctgctactgccgcaattgcaccaattattgcaagaatccagagcactgtattgccgctgtctttcttttcttcttttttgccaaggagttcgtttactttcatcatttctaatacctcatccagctttcccatgcaaaccatcctttcttccctgctactagtatgcttaaatactgttcttatcataccactttttacatttctttactattaatttttcatgaaattactatgaattaacatttcaggaaataacagccagccgtttatatctttttcaatttagcaaaggccgcatacatgatcttctgtccggcgccgtcaaaattgacagttacctgataatccctggggccatccacaatacgcagaaccgagccttccccatacttgatatggcggactctgtctcccacaccatattccaggctggcctgtttggcgcctgcgcctttgcttaagccgttcactcctgcaagacttcccaggccctgggcaataaacggcttattttcctcagccgtccgcttcggcttcaccacagccttcggcctccagtctcctgattgggctccgccgccgtaattgcccccataaggagctgtctggaatctggctttgctttcaggattctccctgtattcctcaaaatccactttctttttaaacacaggaggcttattatccagcagttcatccgggacttcccgcacaaagcggctcacggggttatactgggtctctccccgaagcatcctctgttttgcacaggtaatggtgagatcctccttcgccctggttatccccacataggccagcctgcgctcctcttccacagcggaaggatcatctgacgtaatggtcatatagctggggaacacgccatcctccataccggccagatatacatgagggaattccaggccttttgcggaatggatagtcatgagcagcacacggttatcatcggcgtccacaccgtctatatcggcaaccagcgccacttcctccaaaaactcacttaaagagggctcgtcatgactctcctcataagcaactactttactcaccagttcatctatattccggatccgatcctcggcatcctcatcatcggactcttccagctccttcacatatccggttgtttccatcacatcatttatcagttcttccaggctgtaatattccagtttacttctgaaggactgaatcatagtcacaaaaggcttcagttttacggcactcttaccgatactcatgatctgatccgcttcccggagagcatcataaaagctgattccccgtgcatcggcatattcctgcacccggagaatggtcgttgcgccgattcctcttttgggtacattgatgatacgccttaccgccaaatcatccctgccgttgtcaattgttttcagataggccagtatatccttgatttcccggcgggagtaaaagttcacgcctcccaccacatcataaggtatgccttccattataaagcgttcctccagcatacgggactgggcattggtacggtacaaaaccgcgcagtccttgtattccgccttgccatattttttctttttcccgatctcaccggcaatgaattctgcttcctcataggccgtgtcaaactggcggaaatggatttgatccccttctcccttatctgtccaaagggccttgtcctttcgttccacattattgcggatgacagtgttggccgcatccagaatagtctgtgtggaacggtaattctgctccagcttgatgacctccgcttccggaaataccttttcaaaatccaggatattgctgatatttgcgcccctgaatttataaatggactgatcatcatctcccaccacgcagagatttctgtatttgcccgccagcaggcgcaccagctcaaactgggctgtgttcgtatcctgatactcgtccaccatgatgtaacggaaacgctcctggtaataatccagcacatccgggcaaatccggaacagctccactgtttttccgatcaggtcatcaaaatcaagggcgttatttttgcgcagaaccccctggtattccttatatacggaggccaccttctgctttccgtaatcccccattgccttcagctcatactcctccggagaaatcaaatcatttttagccgaggaaatggcggaaagcagagcgcgttctttatattgtttggtatcgatttccagacgcttgcacacatccttcatgatatttttggaatcatcggtatcataaatagtaaaattattgccgaaacccagccgctctatgtatctgcgcagaatccgcacacaggtggaatggaatgtggatacccatatgctttccgaaccgaagcccacaatatcatccactctttccctcatttcacccgcggccttattggtaaaggtgattgccaggatattccagggattcacatttttattttctatcaggtaagcgacacggtgagtcagcacacgggtcttaccgcttcccgcacctgcaaggatcagtacggggccgtccgtatggaaaacagcctcctgctgcctgtcattcaaggaatcataaatgctcatttttcttctccaatctcagtccttccgtaaactcatgttctttattatataggaacatgcattcgatgtcgatagggaaaaagaaaaactcagtagaccagggcaagaacgccgaaattacttgtagctacggttaccgtcctgggatctgcgtctaaatcaggcaggacttccaccacaccgttggctatactgattacctgaaaattattccaggcctgaaactgatcgggcactcctatggtaagaactacaggagccaaggtacggggaactactgttgttctgccgcccgtggtctgggtaagctggatatccagcatggctaacagatttcttccgttcagggcagctgttgtcaacacagcctgtttggcctgagggcccgtttttccctctgtgacggagaagtatacggaggctccgcccttaatctgagcatcagaaaggcctgctgctttctttaccatcccttccggagaaagaactatcaccccttttaccgtatccgcataaaaataggtaggaacggtggaatttaatttaataccggtgctcatctgcaccacattaggcttggtgggcgccggagcatttccgctggcggaattgccgctggcagaattggaagctcccgccgtaatgggaataatgactgtcaacagtacggcagctgccagatatgttatccacttctttgttttgttcataacacctctccctttcttgtctgcaaggattcacatgggcttctctgttttcattttagccgattgcttctctttatacaagtcttccgaacggttcgtgtgcagacagcgctgctcactcagaacttttatctgcacacgaaccgttccgggaaagtcccaatatcagaaacaggagcggcgtgcttgttatctgctggaaactgaccatgttatgtattgtataggtaacaaggactgctgcaccgatccatgaagaaagattccctttctttaaaaaccgccgcgccatgcctgccaggaatcccacataggtaaaaaggcccgctaatccggtgttcatgagaattgtcatccattcattatggcagtttgtcaaaaccgcttcccgatacgctgtactaaggagaggattgtttccctgttccgtatataaaaaggctctcagacagtccggcccgatcccaaacagctttcgtaccgtggattccctgagccagatatccatgcactctttccagattcctcctcttccgtttccccattgttcatcgaaaaccagaagaaaggggaattgtgatttcagttcatccgatccccaaagccctgcggccataaataataccgcatccaacaataatataacccccaatataaggaatccttttttcatgcgggcaagcagccggagacatttttccggctctgctttactgctccatagtctccaaagtcctctacacattagtgccgccagaaaaaccggcaccatgattgtcatatggatgagtgagaggcttctgctgtcataaagaattctctgcggaaagcaatcccggaacagagcccctatcagccaggccccggccgctgtcagaaaaacatcccagaaagcatccatatccacggtatctctgcaggatatcaggaacagaaagctgaggacagtccccattaccaacagcccgctgtcgcttccctgtattgccgcgcaaagaaatgcagcggctgtaaacagcccggcagctatttttcccctctgttttcccgcctgtttccggccgccggaacgcaggcttccccagaacagtaccgtgcctgccggcatcataaccgacagataaccgcacagccaatttgtatttccaatagtggaaagagtattttccgtccttccccggaaagcaacgggccatatgccgaaccggttcagcacagccagcacacaaatgaacccgcagacagtcaatataaccgccaacacctctttttctgcttcccacacatacgcataataaaaataaaggatcaaaaaactgatctgggaaaaaagtcccatataccagccctctgctcccaacagtccttctcttttataaggagaaagcagaaaggacaaaatattgcataaaccatacaaaagcagaaaaatttccggaagcagtaagaatttattccttccaatacccgattttcccagcctttccccctgcttggccgcctttatccctctaccaataattaaaaaaagcaatatcggcagaaaaaggaatcctatgttccggtagagtatgaattttcccgagctgagtccataatagccatcatacatatacaatggaaccatgcaggccaccatgaacaaataaatggccgatatcccatggattattccttttcctgccgtttcgcctcttttttcctgactgttctcttttatcattttctgtaagcaattcctttttcttctgcagccggcatattcgtcatttccagaaacgtcccaaatacgcttccgcttcctgctccgtaagcgcaaaccgctgctgtagtttggcctgtacctgctctctgctttttccatcctcctgcatatccgcaataagcatggctatcattctatccttttcttcctgtctcccctcattttttccctgggcacgtccctgctgccagacataatcctccctggccgccttatctcttatgtatttcatatgctcctcgtatcgggcccgcagccgttcactcagactcattcgcttcacctcacgtatcgcctcccgaagacctgccttttccgtttttatcatttccaaatcctcctcactttctgcattaaacagccgtatccaatcgtctgccgcttcatttcccatgagttttttcttcaattcaatcgtatggatttcgaatacatcagagaaacggtttcccttttcatcctgcagaaaatatatactatgatattcagggcgatccgtcagattgaaatccagtatgctgattcctatacaccgtttcagtttggagtaattctctcccaccttcaaatccgatgtgaacagcttcgacagatagaaaatctgccgtctgtcccagctggaactggctttaagctgtatttcaatattgattctggtatcatcattgagttccagcaggatatccagaatccccagtttctgctttttataccgtttcctcaaaaaagggttcagcagacgagcagtgcggatttcctcttccggtattcccagaatgtcactgagaaaagccttccgcacaatttcattacgaaacagttccttcatacagtagtcgtattttggtgatattattttcaataacacgctccttcccgatacaaaaagagcgtgcagaatcaccatctacaattattatacccactctccgtgtatcccacaatcttttttttgactggcttatgctcccggcgagatgccggatgaatgccctgaggcatgaatgaaacatgataataagaaccgggaatcacgaaatatccccgatgaataaactataacaaataaacagctgtctggcaagcaaaaaatattctgcaaaagaattcagcggctccgctgattcgcaacacttgggaacctttcttaaaaagtgcacattccgagccgtcttttcatacaatatatcatcaaacctatggagggatttatgaaaaaaagaattctcgcatttacattagtgcttgccatgactcttttctgctttgcaggctgcggcaagaaacaggaggccgtaaaggataccccggataaaacaatgaccgatgtcacattgaatgaggttgctcattcgattttttatgcgccgatgtacgtggctattgaagaagggtattttgcagaggaaggcatcaacctgacgctggttaccggcttcggagccgataaaaccatgaccgccgtacttacgaacgaagccgatatcggctttatgggctctgaagcctccatctatacttatctgggcggcacggaagattatgttgtaaactttgcccagctgacccagcgtgccgggaatttcctggtagccagggaacctattgataatttttcctgggatatgctgaaaaactgtacggttcttggaggaagggcaggcggaatgcccgagatggtcttcgagtatattttgagaaagaacggcattgatccgatggcagatctggatattgaccagagtatcgacttcggttccaccgcagccgctttttcaggcgggcagggcgattttaccgttgaattcgagccgcatgccaccgctctggagcaaaaaggcgacggatatgtagtagcctccttaggcgaggattccggctatgttccctataccgctttttccgcaaagaaaagctatatagaagcgcatcccgatgtagttcaggcgtttaccaacgcccttcagaagggtatggactatgtgcagtcacatactcctgaggaaatcgccgatgtgattcagcctcagtttgaagagaccgataaagaaaccattaccactattgttaccagatattacgatcagacctcctggaaggataatctgatttttgaagaagacgcattcactctccttcagaacattctggaagaatccggtgaattgtctcagagagttccttacgcggatctggttaataccgaatacgcacagaacgccgcaaaataatagcacaaaggctgatacacagggtttgattcatatctccctgcgtatcagccttttttgacaataaattcttattcttttttatgaagcccagcggaccggctgactgtaaccgcgtcctgtccgtcactgaagatacggatgtgtatagggcgcgggttccggtccgcagtaaaggccataggcatcacagatccaatacgtaccgttcacatttacacggcaccattgatgagaatactgattctcatttacatgctcatacgggattccaagaatattcaggcacaggcctgtcgcccttgtacacccggcacaggatgccgtatgtaaaataaaatatccatatgggtcattataatggggcgatgacatggaataaagcattccgctgtccaccatggcgcgaagcgactttgcaatgccgataagctgttcttccctgggaagccccgctaagggtgttgcaaccgccagtgccgcattataagcctgcgcaagttccccgtccgtcgcttttttccgaaggctggataaatttgcaagcttctccatgggaacgggttcaaaaccttttgtctgattaaggttttcttcattgaacacctctatttcagctcccggttcagccgatgcattcggcagccgtccttcgttcttaccatacagcagatagtggtttaaaagcgcatcagcatccgttccgacagcggcggcaacatccggataggcagcggcataataaacgggatcaaacaattccgcggcatttaccggaatttctgcagcggcggaaatcagaaatacggtacagaatacagacaaaacaaacaggactttcttcatacttttcacgtgcacacctccttacatataactgtcttacaacaaattacataccaacaaaaaaagtaccgcataagcgatacttttccaatggagcatacggggctcgaacccgtgacctccacgctgccagcgtggcgcgctcccagctgcgctaatgccccgtccgtgtattatcatatcaaaacttctcccacttggcaagaaaaattttgtcaggttttctgtttttttcaaaaccagattttccttcttttccataacataaattcccattccgcaggagaaccataagaatcggccaaagcctgcatatggtcatggctatattccctgtaatatgttaaaataggacaaatcacctcatcctgttaacagatgaaaggatccttatatgaaatacctgaaaacccggataaataaaatcataatcgctgtactattctgtatcctgcccgctggcggcctcactgcctgcaaaggcccggctgctccccctgccgagacagacacacagatactgtctgaaagcatcgccgccgaaacgtccggcacacaggaaaattcttctcctgaatacctagccctgacccctgagcaaaacaccccttcctccgatgcctccagcgaaaacctgccttatgactcagaaaccatcattgaggagcagagcttttcgggcatggacctgggagactacagggatgtccgtttcacgaccagcctggttacccgcgacggcctgccgcatatccgatactctctcgcctcaggtgaagagaccgtttataccttccctgatgcctatgcgtcctggcattttgaagataccattaattttattaccttccatgacatcaatggcgacggcaaaaaagacgtcatcacaagcgaacaatacacaaccggtgccggcaatgaagacgcccgtcccttttccatggtccgtatttacctgaaccagggtaaggaatttctctttgccgaaggcctttccatctctatcggcaacagcctggaggtttccgacggagatgcctataccgcagaaaatgttctttccgtactgtccgagccggtctactgtaacttttacgggacggacggctggaccaaaggcgagatagaaagcttcgccttcctggtaaaggaagatgtcctgaccgacgacagagaatccctttcccggaaagtccggtatcctctgcacatcgtccgcgacggttccgaacggcagattaactccccggaagaattcctggaaaattacgacctcattctgaatctgcaggtaatctatgatgtggaaggctccgaaaccgaaggacttttctggaatcagaacggggttatgctgggaaccggagccgtatggttcgggaaaacggaagacggaacggttaaaatcactgcaatcccggcagaagtgcagtattgtaatccgctgaatgtggattaaacagcctgaaaggcataaaaaatctgccttctattttagataaaaggcagatctgtctgtcagatggacccgaagggattcgaaccctcggtctctgcgttgcgaacgcagcgctttcccagctaagctacgagccctgaataatttccgaaaaaaatggaggcaacgaggctcgaactcgtgacctttcgcgtgtgaggcgaacgctctcccggctgagctatgtctccatgggtattattgtaccacttttttcgaaattggcaagtatctgttttacaaaattattcttttttttgctcaggattcccggaagccccattttccgcggtttccttcgctgccttcggctgaccttttttcccctttggcataatttgggtaccgcacagatccagcagcttctcaatcagcagttttttcacatacacatcaaaactcagcatgcatatgaaggaaaagaactgtaagaactgtctttcctcttcctccgcctcctgaaaggtatcgcctgcttttttaaacttttccaccaggtccttcttcattacctcaacctgttccttttccaggctgaaaacctcattgtaaatatcctcaaggctgagctccgtatttcctttaaaatacagatccgtaataggctgaagaattgtctgtatgtcattaatagacatgacgcccttgtaataatagataaatatgagtatgagcacatgctccttggagtatttcttcttcaccggcggcggaagcagattgttcttcgcataattattaatcatggtcttggtcagaatcttatcttcctccggatttctggtgctgtttttcagcttgctgtccatcagcgtggtaacctgatccatatataaatcaatattgggaatatcctcaggcttgatataatcgattctgtcaagactttcaaggatactgttcaataggtcttctgtagaaatggtcatcttccgctcctgtcctgctccctttctaagggcagccctgcctgctgcttccttcttctacccggaaccagacttttccgtacgtctgatttttattatatagtatcgaaaactacatgacaagtcttatctttatcatacagacatttttctttactttaagactttagtatgttaaaatcgcaatatatgaatggcagactatttttctctgccatatggatcgaaacagaatcaatgcggaggtaataaaatgaacaaaaaaataaaaacagacgcggtggatcacctttttgaggccatactgagtctggaaagcagggaggaatgctacagcttctttgaggatctgtgcactgtcaatgaactcctctccctgtctcagcgttttgaggtggcggcaatgctgcgggaccataaaacctatcttgatattgccgaaaaaacgggtgcttccaccgctaccataagccgtgtaaaccgctcgttaaattacggaaacgacggctatgagatggttttttcacgtatgaacaaggattcctgatattataaaatattggtaatttttttcaaataagaaatgttataacgtaaaattccactttacatttgactactcttgtgatattctgactatgttgcagggcaacataactaattcttatttatttatgcggaggtatcctagaatgaacaaaggtacagtaaagtggtttaacaaccaaaagggttacggtttcatttctgatgaagcaggacaggacgtattcgtacactactccggattgaacatggatggtttcaaatctctggatgaaggcgctgctgttgaatacgatgttattcagggagaaaaaggccctcaggctgttaacgtagtcaaattataagatttcactgtaaatcttgccaagaaccatcacaatgtgccttttttattcaaatatatcggtatcacagttcatatcgttttttatttgagattaagctgtacagttgtaatggattccacgaatggagttgcaaaacatccattaaaaaaggagctcacgaatggattgatatcctgtcgtgaagctccttttcttgattataaagaggcctgccaagcgggttctcccgatgtttctacagttcttcctccgcatacgcctgcactttatcgaaatccagtttcccgccataaaggttcagggcgctgcccaccgttatgtgtattctgtttcttcccagctctttaatgcttctgatatcctccagggaacgaattcctcctgcataggtaatcggtatccggttccatcttcccaggagagccaccagctccttctcgattccgcacaccttgccttccacatccactgcatggatcaagaattcgtcacagaaggaagccagcatatccagcacatcctcattcagtgtcactctggtatatttctgccagcgatccgtaacaatataataatcaccgtctttttttctgcagcttaagtcgagcaccagctttttctttcccacattttccagaagacggttcaggttttcgtaggaaatggttccgtcacggaatacataggaggtcacaatcacatgagacgctcccgcatccaggtattcataggcattttccgcggtaatgccgccacccgcctgaaggcctccgggataagctctgagggcattcaaaacctgctcctttgagctttcataataagggcttccttttttattcaaaagaattacatgcccgtttttcaggtttttttcctgaaaaagcctggcgtaccaggcgccgtccttttcagaaacaaaattttcctgggcactgtcactgatatctgccacgcttccgcccaccagctgttttactttaccattatgaacatcaatacatggtctgaattccattttccttatctccctgcctcaggccgcataacaacggctttttttacaaaattaggtatattttacacgaaatgctcctttttgacaattcctttttccgcataaaaagaatttttcagaacataataaaaaacggacagttatattgttcgtgagtgtgctttttatttaaggatgcctatccctgcggattttgtccctgtggatatacttccgcatgcacgcccaaatatacaaagaaaaaggagtgagcaacatgaaaaagctgaacagaatagttcctgcagcactgattctgctgatgcttgccagtgtgaccgcctgtggaaataagaaaaataatgcggacgacatggcaggcaatacaacagaatccaccagcactaccgctgccgaagagacagcaagccgtaacgaaacaagcacggccggtcttgccggaagtgaaactacgaatgaaacccatacaaacggtaccgatacaaatgaaaccggaaccatgaacggaaccgatgaaacagccggcattaacggaaccaacaacggaaccaccggcggcaacagcaccgcaggcaagggttccggcgtggtagataacgcaggcaatgccatcgaggacgtaggcgatgctgtaggcaatgtagtggatgatgccggcaacatggttgaaaatgctgcagacggtgtagccaatggtgtgaaggatatcaccaacaccaaataatttctcctgtctttgacctcacccggggcaagctgcagacttgcccctctacatagtttttttgttatacccctttttcaatcaaagttccgtccctgtaagccgcgagcagcttttccagataacagatactttccttcagttcggtaccgatgtctgtatccgcaacccttatcctgctgggcgccgtctccactatgatggaatccgagaaaatatccgattcctttcgtatagccgattccgccgattcaaaaggttcatgggacaccagggtcatcccgtgggaattagccaccagcgtgtagccggcaatcccggttttcccctgataggccttggagaaaccgccgtcgatgatgagcagcttcccaccgcacttgataggagtttcccccttctttaattccaccggtacatggccgttgatgatatgggagctgttttcatccaggccgaattccctcaggatgcggttaagcacctcttcattgtccatcagcctgtaatagctgtttttaatttcggtatgggtgctcttgtcctccacaaaataccgttcgaaggtagccattttatcttttccgaataccggagaattggggccggtccagatataccagatgatgtccctgcctttttccacttcttccctgtcctgagaataatagcccttcctcgcataatgatccaagatatcgtacagcgcttttcctccgtactcttttccgaacacatttaccttgaggaaattcccctcttcatccatgggcacgcagccatgataaagcagattggagttatagaccttgtaaaggcttcccttggaaaaaaggaaacggatatgccgctgcagcttctcacaatgcacaaaagcgtggcgcagacgttccaccacctgctcctcctccggagtgaggcggtaaggatccttcggatccaccgtggggaaatccacatccttcatggcatattccgttccgccgatagtaaccgttttcttttcataatttattttatccagaagcagcctgtcggccatatcgaattccggcctttttttaatcagctgtccctccagcttgaactggatgatggcaatggccttatgcatcttcttatccagctccaggtccttcgtgtcatagtcctctccgtatttaatggaaaaaacatcgcagtcggaatccgcataagtattcatggcaaaggtggcgagcggaatgagattgatgccgtagccttcctccaggatatcgagattgccgtatctggctgaaatgcggatgatattggcgatacagcttgtctgtccgctggcagctcccatccacaccacgtcatgattcccccactggatatccaccgaatggtactggcttaaggtatccagaatgatatggggaccgttccctctgtcataaatatctcccacaatatgcagatgatcgataaccagcctctggatcaggttgcagagcgcggcaataaattccggggcccttccgatgcggataatggtatggatgatctcattgtaataagcttccttatcctgtacctcttccttctccgtaatcaattcttcaatgacataagagaaatctttgggcagcgcctttctcaccttggaacgggtatacttggaagccaccctcttggtcatctgcaccagcctgtgaagggtaatcttaaaccagtcctccagattttcctgattatcctcctcctgcatcaccagctccagcttctccatgggataatagatcagcgtggccaggctccgcttgtccctgctgcttaaggtgtttccgaactcttcatctattttccgtttcacgctgcctgaaccatttttcagtacatggttgaactgctcatattccccgtgaatatcggtcagaaaatgttccgttcctttaggcagactcaagatggcctgcagattgataatttctgtcgccgcatccgcaatggtcggaaactgtttggacagactcttcagataggttaattccaaatcctgcatgcttgcattttcccctttccgcgcaccgtcgaaaaaagggaatccttcgattcccttattctcatccgaaggctttacgcgccctcgatcacatcactcatgtcatataaccccgcaggttttgctttcaggaatttagccgcctgtaccgcacccttggcaaatacatttttggagtatgccgtatgggaaaaggttatcacctcatcctctcctgcgaaaatcacgtcatggtctcctactattgtaccaccgcgcaccgcagaaagtccaatctcttttgcatcccttttctgtcttctggtgcttctgtcataaacatatgtatactcgttattcaattcttcatttatggaatccgccagagccagagccgtgccgctgggagcgtccaccttctggttatgatgcttctccacaatttcaatatcaaagcccgcgggagccagaacgcctgctgcttccttgagaagcttgagaagcaggttgattcccatggacatattggcggatttgagcaccgccgtttttccggccaccgtcttcacccgttccagctgctccggagtaagccccgtagtgcacagtacgacaggcatctgtaccgcttcgcaataatccagcagcttatccgctgccgcagcggaagagaaatcaatgaccacatccgccttcagtgactcatccttttcccatgcctgcctgtaatcttccaggcttttgaataccggatagggattggttatatgatccgacacatccacaccggcaataatttccgtctcactgtctgaagccgccagacgggcaatcacctgtcccatatggccgttgcagccgtgcatcaatatttttaccatactgttctctccttacaggattccataatccttcatggctttttccagcttcactgcattttcctcttccatctccgtcagcggacgtctcagagggcctgcctgaagccccatcaggttcatggccttcttaaccggaatgggattcacttcacagaacaatgccttgcataaaggaatggcctccagctgaagcttacggcttcccgccacatcccctgcaaagaatctggcacagatatcatgggtctgtctgggagccacgttggaaaggacggaaatcacaccttttccgccaagggacagaagcggcactatctgatcgtcatttccggaatagagatccacatcatcccccgccatgctcatcagctgggcgatctggctgatatttccggtggcgtcttttacaccgacaatattgggaacctccctgcacagccttaccacagtttccggcaatatattcacaccgccggtcctgcccgggatattataaagaatcatgggaaccttaatggattccgccacgattttaaaatgctcgaacagccctttctgcgtcgctttattataataaggagttacaacgaggactccgtccacaccggctttttccgcctcccgggaaaggaaaaccgcggtttccgtacagttggaacctgttccggcgataacgggaatcctgcccgccgtctttttaacacaataacggatcacatccagatgctcctcatgggtcagcgtggaagcctcgcctgtggtgccgcatacgatgatggcatcggtgcctccggcgatctgcgcctcaatatgttccccgaatttttcataattcacgcttccgtcctcatgaaaaggggtgataattgctactcctgctccttcaaaaattgccatatgctcctccttattttcaacgcttttcccgcgctgtctgttgcggcagcatagctgcctgatgaaatgcataaacaaaagccttccggcggcggccctccggaaactgccatgcagttcctctgagctccgtccctttgcctgcgtattttcccatggtcaaaaaaattctccggccatccaattatgtaaaaatacggaggcagccggagattatcttctctttatgatagcgccccatcttttacagatgacagtcatacggttcttcaccgcatgcccaagattcaggcaccaggccccctcctctttcggcgctctcccctttcccttttcttcttctgtgcctgtcacatccgaaaaggtactcctgaatcacgcaacctctatctaaaaataatcatagcacgcagtacggttcctgtcaacgcacagatgctatgattattttcctgtttctattcaattatgttacggtcttcccgggatggaaacaccctttatttcaccgtacggatttcagatacataatcggcaagagcgcagacatcatcctccagggatattcctgtcattatgatatccgtctccccgtctctcatatccagcacatttttcaaatccgctatggtaataatatgattatcaacaagccccagcacctcatccaggatcagcatatcgcattcccccgtactgaggacctttttggcaaaattcaggccatttctgatattctgtacctcttcttcctgcttttctctgggaagagccacaaaatcttcgttggatttttcgaaacggaaaagcttgattcccggctccagcctgcgcggatattcatcctcggtcaatcccttgcctttcaggaactggatgattaccaccctcgcccccttagccgccgctatcagcccgcagccaatggccgccggcgatttgccgtgtccctttcctccataaatataaaccttaccttcagccatacattcgcccctctacggtattctgcggcaccggaccgctatcgtcattcgttgcagcgcccgccctgcagatatccggaatcaaatgccttcacactgcctgcggggtctgatactcccggacttgcgctgctgcacataaactgctgcggagtatttgacctgttaatgataccataagcatcggatcgatgcaacttttattcctttcgggaagcctgttcgttactgctgtacccctgcggatacgcggcaatgtctattcctcaatgagctccagcttgctgacagatacctcataggcaattcttttttccagctgctcttcccctacttttttcatatattcacggctctggatcctgccccatacttcacagcgttcccctacattgaatccgccggcaaaacgggcgttgcggccccagcagatacaggggatataatcggactttccgtaaggacggtttacagccaggagcacatcggcaatttcccttcccaaaggcgttttacggtaaaccggttccttacagatatagccgtccagatatatctgattggttttggagctttcctccagttcctccacaaattcaatttcccttgcaaacacggataagatcagtctgttctttctctcctcgtggcggttataggacctgaactgcccggatacgcacacataagcgcccttatagtcctcctccacatcaaggagcctttcggataccatcagaggaatgatgtcataggagtcgctgagtctggctacctccacatccaccatgtaaaaaccctctccgaaaatctcgtggctgaatgtaaagtcactcacgattttccccatgatgatcacctggttgttttcaattaccttatctgtcattttttgttctcccttcttgggcttcgatttgaccgaaaccgcttttaagaattttttcctgtcatgtattactattttatggcagcaaacccgatcctagaaccgccatgggtcgccgcaatttccggaaaatcgacagatatcgggggtttttgcagttttaaggttgcaagatgaaaatatcagtgctatactatttaagtttgatgtcagttgtataataataaggtaactgtccgaaacttctcctgtagccctttgcgcgggacaacatcggaataaacggtataggaagggaatttgagtatgattcaaaaaagagaagatgtgagaaatgtggctattatcgctcacgttgaccacggtaaaacaactctggtggatgagcttttgaagcagagcggtgttttcagggaaaaccaggatgtggcggagagggtcatggactccaatgctattgagcgggaaagaggtattaccattctttccaaaaatacggccgttacgtataaaggaactaaaatcaatattattgatacccccggacatgcggatttcggcggtgaagtggaacgagtgcttaaaatggtcaacggggttattctggtggtggacgcttttgaaggccctatgccccagacaaaattcgtgctgcgcaaggctctggagctgcagctttccgttattgtgtgtgtgaataagattgaccgtcctgaggcaaggcccatcgctgttgtggatgaggttctggagcttttcatggatctggatgccaatgacgaacagctggactgtccgtttgtgttcgcttccgccaagacaggaagcgccactttgaacctcacggtaaagaataaggatatgaagcctcttttcgatactatcctggattatattcctgctcccgaaggggatcctgatgcagggacgcagctgcttgtgagcactatcgattataacgaatatgtggggcgtatcggcgtaggcaaagtggataacggcgtcatttccgaaggccaggaggtcgtgattgtaaaccatcatgaaccggaaaagcagaaacgggtaaaggtgagcaagctgtatgaattcgacggcctgagcaaggttcccgtcaaatcttcttccatgggatccattgtggcgatttccggaattacggatattcatatcggagataccttatgctctcctgaaaatccgaagcccattccttttcagaagatttcggagcctacgatcgccatgcattttatcgtaaatgattcgccttttgccggacaggaaggcaaatttgtgaccagccgccaccttcgggacagactgttccgtgagctgaatacggatgtttccctgcgtgtagaggaaacggataccaccgaaagcttcaaggtttcgggccggggcgagcttcatctgtccgtcctcatcgagaatatgcgccgggaaggctttgaatttgcagtgagcaaagcggaagttctttataagacagacgagcacggcaaacggctggagcctatggaaaccgcttatatcgatgtaccggaagcattttccggcagtgttatcgaaaagctgagccagcggaagggtgagctcgtcaacatgagcgctgccaacggcggctatacccgcctggaattcaacattccttcccgcggcttaatcggttaccgcggggaattcctgacggataccaagggtaacggaatcatgaatacagccttcgcgggctacggcccttataagggggaaatccagtaccgcaagcagggttccctcatagcctatgaaaccggcgagtccattacctatggcctgtttaacgcccaggagcgcgggaccctgttcatcggccccggcgaacgggtatatgccggcatggttatcggacagaacggcagaggggaagatattgaggtcaacgtatgcaagaagaaacagctgaccaatacccgatcctccagcgcggatgaatccctccgtctcagccctccgaggattttaagcctggagcaggccctggatttcatagaaacggacgagcttttggaggttacccccaagaacctgcgtatccgtaaaaaaatcctggatcctaccaagagaaaaagagcgaatataaatagaaattaatgctttgcaaggccgtcctgcttcaattcagcagaacggcctttttattttttccatccctgttgacatcagtatctaatgcagttatacttttgttataaacttttataagttattgataaaagctgcataggagaatatgatatggattccttaactgcccgccccaacattttaaaacaggccaacctgtccctgatccgacgtgctatcaaagcaaagggcacctcaaccagggcggaaatagccattgaaaccaggatcagctccaccaccgtacgttccctgctttccgagatgctggaaaacggggaaatcgaaagcataggcctggatgaatccagcggaggccggaaagcgcagagataccgcctgaatccggaattctgttacggagcggccttctgcctttttgaggatcatgtagtttttctgctggtcaatatatatggggaaattgcagaaaaagaagaactgaaaattcaggacgggaatgtccggcagactcttctctcctttctggatgaactgatcggaaaaaaggaaatcaaatccatcgggctcggggttcccggcattgtagaaaacggctgctactggaaaaagagcaaagaagacggaaacatgtataagtcggacatcggtatctttctgtcggagagatatcagctccccgtgattatggaaaatgacataaacgcaaccgcaatcggcttcggacgctgttatgccaaagaattcccggaagaaaatccggaggataccaacatggcttttctgcattttgaagaacactgtgtcagcgcgggcttcatcagcgcaggccgtatcatccggggctgcggcaattatgccggagagctgggccttctgcccgtagatgcggacaggctgctcgacgaatgtatgacggatcccatggatgatgtccagtatgtcaaccttatgataaaaatactcagctgggtatgcggcatcctgaacccggcttacatcgcccttggcggcccggccctgcgtcccgactgcatcggcgccgtcagcgacgggctctccgctcttctgccgggacacatggcagcggaaatcctgtattccccggatgtacgccacgattactatgacggcctggcctcccttacggccggacgcatatttgaagaaatccagtttatcagagaataatccctgctcacagttcaggcgtaaccgccctccggggcgggcgtgacttttcttacgagcatttctgccggcatgtaccggtggccttccggccgccggtacatgcccctttactcttcaaaacacaattccatattcttctgttatagtgaggtttagataaaaaacataggcaccgccgtccgtgtccctgccgcctttcggcgctgccaggttccctcctcctttcccctgccgcactgcaaggattcctgtaaggggcgtataagcacgccggtccttaggctgcgtattttgcagccttagtaccgctgcgtgattatccgagcgagagcgaaaacgactaaagtcgttcccctgcaaggaaccttgcagtgcggcaggggaaaggaggagggaaccgggcagcgccgaaaggcggcagggacacggacggctgcgcctatgttttttatctaaaccctgcttgcttctgtttgactttccggctgaaaatcattaaactgattacatacgcaaacgctgcaaaggaggaacatatggctgattccaacataacaaaaaacgctctcgcttcttccttaaaatccctgatggagcaaaagccatttcaaaaaatcaatgtaaacgatatctgtgaaggctgcggcatgaaccggaaaagcttctattaccacttcaaggataaatatgatctggtaaactggatattctataccgaatttgtatcccatatccatgtggagctttatgacaacggctgggatcttctggtggatgtatgccgctattttgaaagcgaaaggaacttctaccgctgcgccctggcgattaagggccagaattccttccaggattattttctcgaaattatcaggccgctgatccctatctttctttccgacagcttaaatacctctgaggatcagcagtttttactgaattttttctatgacgggctgatttcctccctgatccgctggctgtccgaggaaaatgaaaccactgccgaggaatttacaggccacctgaaaagtgtccttctcctttttgccgaagaaatcttcaataatctgaaagatactccttccgctcctcagcctgagtgatttttctttttttattccaccggtaatggcggaaggccagcactccccccggaatacagggaaaaaggaatgtggcaaaacggtacatgagcgccgcggataccgcgcttacgctgcccgcatagactccgaaaaacagggtgaatacatattccacggaacctataccggacggcacgggtatgactgccgccagcatctgtatcagcgcggtcagaagcatgatctccggcaggctcaggggaatcttccccgccaaaaaaagccagggaacggcgtaccagaagcttactttcaatatattcaaaaggataatgcataacagctttttcgggttcttcagaagaaggcccgcttctttctggcaaagctccgcttgttcttccaaagtgagaagcttttcctcccatctgccctttcctttctttttcaaaaaagtaaaaatgacactgcaggctcttttccctatcgccacaaaaagcagggccgcagttaccagtacggtaatcagacatcccagcagcatcagcttcccatatcctctgacacagctctccccttttgccgtcaggatcaggaagccggctattccatacgccgccaccgctaatttatacataatatactgtaccagactcatccccgtagctgttccggcctgtaccccatagctgttcagataatatatttccgctatccctgaaccgcttcccagcgtcgccacccggtaaaattcacagtaaaatgcacaggtaatacctttcccccacgtgaatgcagactggtgccgcagaggctcattcaaccggggttcattcaaccctgtcatcacctgtattattttaccttccgtaagaaaataacctgccgaaagcaggcaggacatcccgatcagtatcggagaagtccttgccgcctcccgcaggatctcaggtaaaacttttcggttcgccacgcagaccagaaagataagtgccaggacgaacagccattttccccaatttttacgtattttcaatgcaccatttccttcttctttctttttttctccatttcctgctcccacagttcatccgcgatgggcgcccattctgcggcgtatgcctcacattttccgcataaatgatccgcgctttccgggcactgcagatccgtggattttgccccggtccttgcaaccatttcctgaagcagctccggattttccagcatagggcagggacgcagcaggttatcgttaaaaggctgccctttccgataagccataaataacggctgcttcagcgcatccagcagtgatacctccctgatattcgcccctgaataatgtatgaatacacaaggctccacatcaccgttcggattgatatgacagtagttccttccgccagcaatacagccgcctacaaactgcccgtcattctggaaatcaaaggcaaaaataggctttcctccctccagagcccggatctcccgcactctgtggaacatatagacccgctgctccatggtgggcatcagttccggtgccgcatcatttcctaccggcatataatggaaataccaggcataccggcagcctttttcaatgatcatatccaggaattcatcactggtgaccgcttccacattatttctggtgtaacaaatagaagtcccgaataccagcccgtgtgctttcagccgatccatggcttccataacccgttcgaagcacccgtcgcctcttcttccgtcattcgcattctcaaagccctccaggctgatggacaacgacagattacccacccgtctcatttcctcacagaatgcatcatccaccagggtaccattggtaaaagcatggaattcacagtcatcatgcttctcgcacagacggataatatcatccttgcgcacaagaggttcgccgccggtatacatatacagatatactcccagctccttcccctgcgtgataatgctgtccagttcttcatagcttaagttcatcctgtttccatattcagccgcccagcagccggtacagtgaagattgcatgcactggtgggatccaccagcagcagccaggggatattacaattatgtattttcctcatctgatttattcttttcgttccataaaaaaatgcttcaaagcccagattcagtgccgtcatttttaccacatgaggatccacttcatttaatatacgatccgcatatttcatccactttccgtcagaattctttacaagctccctggccttgtcataatcctccttctgtaatttatcaccgtccataaatttttcagccaaatcaatcagctggagaaaacttttttcccgatccttttttacatgttttaaagccccgtcaatagctacgctgaatgctttccgttccgcctgatgtgcaaattccataacttcctccgttctgcggacaatagccccgcctgtttcctttgtaattgttatctatattttaattgtaagaaagctctctgtcattggacactcttttgtctgtgtccctatttgggacaaataaaaataatgtcccattttcagacagattgacaaaaatgtctcttttagttacaattaccggcaagtatgatacaattaacaaaagaaccggaagtatataaatcaataaaaataaaaacaggaagtgatatcactgaaaacagaaaaagtaacctattctcttatagaagcggctgttaaccgcggcattaaggaaatgcaggaggatcccaagcggagcgtccggaagctggctgatctggggaatcagtttgccaggggacgtttccagaaaagcttctttgaattgtcccagactcttcttcaggacgatgactgtccttattatacactcctttcccggctcaccgaagaaattgaccatgaaaccctcaaacgcttcggcgtcaacctggggtataccagctggacatatggtgcacagctcatccgtgcttacgaaaaagagcatggttttgaggtaccctggaccatcttttttcattaccatccccaggcttcctttactctttcccacatggacagcctgatccgggaggggcgcagcatcggtatcttcacctattttttgcgcctggaaaccattccggaggattggagcgcgttgacggagctgttctgccgatatgaaaacagcgcctttcttttattccttcccgacgaggaactgaatgaggacgcggcaggcattctctccgaatgccataatgtcctgatctcggccgagctttcctcctgttataagaaaaatatcagtctcctgaagcagaaaagctgcctgacggcgaatcaccattattacctggaaaccgatgacgaaacattgtcctgccaattgaaaggctgtgaatccccctttcttttcctcctcgcccaaaacggctgcagccctgcggaccaggagcagctggctgaatctgtttatcagctgcgctgtcatcctaaatatccggtttttcccatggagctttttacggaccataaaagaatcgatcacattatttccggaaaaacctgttttatggaaataaattccgacggaacgttttccctccccgacggcagcaatctttccgtcctggagcctgaagcctcccttccgtcccttctccgtgaaatcaccttaacggcctcctgcgaaacctgcagctgacacaggaaactctttttacacaaaaaaacagcctgccccttccccggcatcgttctgccgttggatagagtatggctgttttttactgacagtttcagttaattcccgttatcgcaaacccgctgtctcttccatcatccttctggaaaataatattgggctttccttcctccgcacctaatacatatttgcctccgtccagttctttcagttcaaacagattggtgccgagcaccgccttcacccgttcctccgtcaggatatcagacgccggaatcttcaggaaatcaccgccgctttccaccacctgatccttttctccaaggtttatgtaaacgggataacccgccagctcggaaagggcattaatgtctctgtatttacaggcaaaaagcacatctgccgcaaaggaaagggcttctctgccggccgcaggcttcctgctgctgtccgtcacactggaagccatgccgtccttgcaggaaacagtaacagcctggcccagaagcaggccgtccgcagtatccaccacatcctccgtctccggaaagctcaccgcatacatctttccttccgccgtgtcaatcaccatgctgttcattgccgcatccacgataataccgtcataggtgcctgtgggcgccatttcaatttcctcggcttccatatcataaggaacgctttcctgtgtactgctttcctcctgagagatttccgcctcatcgctctcctgctgcatctggctgtcttccctgcccgaagtctctgtctgagcgatgctttcggcggtctgcgccgaatttttgccgcatccggcaaataacaggacagaagctaaaattcctgccgcaagcgccgcactccctgcctttttactccatctgaaccttttttccatcatactatttatctcctttttggctatgcttcctttaaaatcaaagcaacgggacaatgatccgaaccgaaaacatccttataaatcaccgcatcctccagcctttccttcagctgcggggataccaggaaatagtcaatacgccatccggcattcttttccctggcatggaaacgataggaccaccaggaataagcatctttcaaatccggataaaaataccggaaggtatcgataaatccattctccagaagaacggaaaacttttctctttcctcatctgtaaaacccgcatttttccggttggtcttagggtttttcaaatcaatttccttatgggccacattcagatcaccacagaaaatcaccggctttttctcttccagcttcttcaggtatttcaggaactcctcctcccaggtcatccggtagtccagtctcgccagcccatcctgggaattgggggtataaaccgtcaccatataaaaatccgggaattccagggtaatgaccctgccctcctggtcatgctcctcaagccccaatccgtacgaaacggacagaggttcttctttcgtaaaaattgcggtccctgaatacccttttttcaccgcataattccagtactgatgatatcccggcagttccagggaaatctgcccttcctgaagcttactctcctgaatacagaaaatatccgcatccgcttccttgaaaaaatccataaagcccttgcccatacaggctctcaggccgtttacattccatgacaccagtttcattccgctcctccttcttcatccattcctctttactaaaactgcagcaatacggtggcaatctggaaataaatcaccagagacagcgcatccacaattgtcgttataaaaggactcgccataaccgccgggtcgaagccgattttcttagccagcataggaaggctgcagcccacgatctttgccacaaagaccgtaaccacaagggttatgcaaatcacgaacgccacctggacagccaccctgtcaaacagcatcagcttcacaaaattagccgccgacagcgtaacaccgcacagcagcgccaccctcgcttccttccagattaccccgggcagatcatagaagcggatctcatccagggaaataccgcggatgatggaaacactggcctggcttcccgcatttccgcccgtatccatcagcatgggaataaaagttgacaacaccatacaggcgctcagcgccgattcatagctggcgataatccgcccggtaaaagtggccgacaccatcagaagcagcagccagggaatcctttttttccaggtttccagcacaccggttttcatataaggcttatcgctcggcacgatagccgccattttttcaatatcctctgtggcctcttcctgcaggatatcaacgatatcatctaccgtaataatacccacaagcctgttttcattatccacaaccggcatggccgtaaaatcgtatttctggaactgcctggcaacctcttcctgatccatcatggtgctgatagaaataacattctcatgcatgatatcagaaatcacttcatccggctggctcagaagcagataccgcagggccaccgttcccaccagcttcctccggctgtccagcacataacagatattaatcgtctcactgtccaccccgattttacggattctggcaatcgcctcatccacagtcaggttttccttcagatccacatactccaccgtcataatgcttccggcggaatcctccggataacgaagcagatgattgatatcccttcttgtctccggactggcgtttgccaggattttctttaccacattcgcaggcatctcttccataagatccgccgcatcatcggccatcagattatccacaatattagcggcatctctgtctgacagggatgtgatgataaactgctgattatccacatccatatacgaaaaaacatccgctgccagatccttgggaagaatacggaaaaccttcagcatatcctgttcttccatttcctccagcagcgctgcaatatctgcatcattaagctccgacagcatctggcgaagccttgtatactgcttgctgtcaagcagttctcttattaccttgcgttcttccatgacaatctccttccggcggtgtcatgacagctttcaggcatggatctacccccaaacgggcacatccggcagctttcctgcaaagctccttccccgccttacctgtaatcgttatctgactgcaacttcgcccggggaccggaacatcactgcttcctgccgttttgctcttcattaaaaccaccaccttccggaaagttatttttaccttaataccagttttaaatactcattcactatacctttacaattaccctttgtcaataaaatagtatctgtcaactgcttccagcacggcccttccccccgtcgcctccgtcagctcttttttcagccgctcctcctcctctgccgcaaccacagtctccagcgacaccctgtccgtatactccgcattctcctgcaaaagcccccgcttccccagaatatactgaatacgcccgatatccgaataatccgtcccgatccgaagccgcgtcccataccgcataacagccaccctgctgttttcaagccccgccttcaccgccgccccataagcccttaccagacccccggtccccaacagcgtcccgccaaaataccgcgtcaccaccaccgcaacattacaaatcccttcccccagcagcacctccaacataggcctccccgccgtccccgaaggctccccatcatcactgcaccgcgtcagctcagcccttctcccaatcacaaaagccgaacaattatgagaagcatcccaatacctcttcttcacctcctcaacaaaagccaccgcctccccttccgtctccaccctcctgacctccgccaaaaaccgagacctcttctccacaatctcccccgtccccccttccaacacacatttatatggtaagaactgctcccacttttccataaaattacctccttactttctatccttctatccttccatccatattatcttaccatacccaccccaatcatgtatattccatttctattcccttcccctctcctttcttatccactgcctaccccggttcgagtccccatccccgcccgccgccccggctgtttccctcgccctggcagccataccgtcccatggttcctgcggggccgcgtatcctatatagctccggctgcatctcaaaaaaaaggagcagtttcttactgttttgatcctgttcttccctgcccgcccttagcggcgctgtctgacgaccaaagggaggagtttaagccgcgttggcagcgaaggacaggaacaaaacagttagaaaccgcccttttttttgtctgcagccggagctatataggatacgcggccccgcaggaaccatgggacggtatggcatggcaaggggcgagggaaacagccggggcggcgggcggggagggggactcgaaccccatacccccatgtttaaaaccatctaatattgtgaacaattcttaatatggaagaaaaacctttatttacctgtccacatttgctataatctattaggtaatgccattttggcccatactgaaatggccccgaaatgggacattacaggttgttttttatggaaccatctccatggaacttccagttttagtaaggaggcataattcatgaattatggcaaaagaggtgccgcaaagaaaaaaaaggcactgcgttccaaatcaaaaaaatggagcaaacgatttgctcttaccttttttaaaaccattttactggtcatcctggctgcaggcatcattggtatctgcgggggcttaggcgtagtcaagggtattctggcctctgcaccggatatttccaatattgacgtatcccctacaggcttctccaccttcgtatacgataccgaaggaaaccagattgccaagcttgacgcagaaggatccaaccgggttcccgtaagcatggacaagatccccgaggatctggcccacgcctttgttgctatcgaagacgcacggttctatgaccataacggaatcgatatcaagggtattctccgggccggcttcatcgggctcacctccggtcacttttccgaaggcgccagcactatcacccagcagcttatcaagaacaacgttcttaccagctggacaagtgaaagtgaaaaggcctttgccgttaaagtaaagcgtaaattccaggagcagtatcttgccatcaagctcgaaaacgatatggataaggataaaatactggaaaattacatgaataccatcaatctgggacagaacacccttggtgtccaggccgcatccaaacggtacttcggaaaaaatgtctatgaactgaacctttccgaatgtgccgtcatcgccgccatcacccagaatccttcccgctacaatcccattacccatccggaaaaaaatgcggagcgccgggaaaaagtacttaccaacatgctggaacagggttacatcagccagtccgaatttgacgcggccctggcggatgacgtatactcccgcattcagacagtgaatgaagaaaccggggaaaacgccatcaactcttattttgtggatgccctgaccgaagctgtcatggacgatctggaagctgccggttattcggaagcccaggccttttccatgctttataccggcggcctgaaaatatacagcacccaggatcccaccatccaggccatctgtgatgaggtctgctccaatgaggaaaattatccccagggaactacctggtacctgaattaccagctgaccattcagcgttccaacggggaaaatgataatttcagcaaggaaatgctggaggattacctgaaggaaaacggaagcgataagaaatatcctctcctttttccctcccaggaggatgcctatgctgccgttgaagcctataaggcatctcttcttcaggacggagacgaggtgattgcggagagtatctccatgacgccgcagccgcagatttccatgactatcgaagatcagtccaccggaaatgtggtcgccatcgtgggcggacgcggggcaaaagaagcaaaccgtactctgaaccgcgcaacctccactacccggcagcccggttccacctttaaaattgtttccacctatgcccccgcgttagacagcgccgggcttactctggcggatgtatttgtggatgctccctttaattatgccaacggaaggccggtttccaactggtacagctccggttaccggggaacctgttccctgcgggatggtatccgggattccctgaacatcatcgccgtaaagaccctgacctacatcactcctcagaaggggtttgattacctgcagaattttggctttaccactttgatagagcgggaagagaaaaacggccagactttttccgatattacacagtccctcgccctgggcggcattacctatggtgttaccaacctggagctgaacgcctcttatgcgaccatcgcgaacggcgggacttatatcaagcccaagctttataccaaaatcgtggatcatgacggaaatatcctcatcgataatacggaaggagaacgccgccaggttatcaaggaaagcaccgctttcctcctcacagatgccatggttgacgtagtaacctccggaaccggaaccagcgtgaatttcggcggtatgtcaatcgccggcaagacaggtactacatcggattacaacgatgtgtggttctcaggctatactccttattatacctgtactacctggacaggctatgacaacaatgccaagctttccggtaagaacggggaacggaatctggctaaaaccctttggcgggctgccatgagcaaaatccatgaaaacctggaaaacaaagccttcagcgttcctgccgatattgtaaccgccaccgtttgttcccagtccggcaagcttcctattccgggcatgtgcgacgagactttaaaaaccgagtactttgccaagggtacggttccttcggatacctgcgacgtacattatcagggcagtatctgtgaatattccggcctgcccgcgacagagctttgcccgttccaggtaccgggtaccataaccatgccgcctgccctggatgcttctctgagcggaaatgcaaacacaacggaggaaggcactgcggttcattgtcctcacgatgccactttcatgtccgatcccaacgcggcggcagtcattgcccagcagcgcatggaactggatgcaagaaatatgcttgccaattatgatattcagatggccaacctgcaggcagctctgcagaacgcccagaccgtactggtaagcgcccagcagcagctggccgcagccgtggatcctgacagtcaggcagccgcacagaatgcggtcaaccaggctcagcaggaaattgaaaacctgaacgcccagattgctgcgcttcagaatgcctatgtattacagcaacagcagcaggccgccgaacagggcggagaaggacaataacagtcctaagtgttcctgcagcagaacgaatgaaaaagagaaggttaccggtaagattcccggtgccttctcttttttcatttccttattataaaacaatctcatatttagtaatgtccaaaacagtctcacccttacaggaaaaggaaatcccctccgcttcaaggggcgtataaatcagggaggtcatagcctgtttcccatcattcacgaacagctccaccgtatatttgtccaaaagcagcctgagcttcagctttccttcttttgtatccacatacatggaacgggtacacagcagatcctttttcagaccgctgcaggtccggtctgtagtgagcgtccccttccctttctcataggagatggtcgtctcacagccttctcccacagcaagatggatggtaaaggaagcgctccggctcacatctgcctccacaatcatatccaggactcttccccggattccatccagttccagagagccttgctgttccgacagccttatgcctttacaggatacttccttctgacggtagttttccagctccctcaccgggttctgaatcagccttccttcccgtatttccagttctcttgggatggtcatcattcccgaccacaggaaatcctccggtgtcatgtagttgtcccagctttgcagccagcccaccatcactcttcttccgtcttccgtttccaccgtctggggcgcatagaaatccaggccgcagtccacacttcgtgcctctcctctcaggaagctcctcttttcccggtcataggttcccacaaaataaatggagttatttccgttatggaattccagtccctccgcacgcatgaactgaggggacactatcagcacctgcttcccatccagcgggaaaaaatcgggacactcccacatttttccgtaccgttttccatttgcatccagaatggactcaaacctccactcttcggcatcctgagaagaaaacaaagctatctgcccgcttccgtcagctcccagactgccgactgcggcataaaaggtatttccttctttccatatcctgggatccctgaaatcctccccggaacttccttccggcagcgtgtcagcggtgatcaccggattggcaggaagcttttcataatttaccccgtctcccacggcgatacattgtgtctggcgaagggtatggctcccgtccgcttccactctgtccagaacaccggtatacatcagaatatgttttccctcatgctccactgcacttcccgagaaacagccctggccgtcatattcggtatcaggagccagggcacagggcagctgctcccatttgataaaatcccgggttttctgatggccccaatgcatggggccccacacggagctgtaaggatgatactggtagaacagatggtattctccctgataaagggaaaaaccgttgggatcattcatccagcccacctccggcgtcaaatggaaaacacatttctgcccgtccggaatctgtttccccactttcccctcatagcttctcgctctgtctaaattactgctcattccaccgctccttatatcgctttcttcttttccgtatccgatttcccttacctgggccagcgttccttcctctccatcagctctccgaacggctggtgaggctccgtctgataccagtaggctaccgtcgccacatcgtcctgacgttcaaacaggcctccgtgatatacaccaatctgctggactgtcaccttcagatcttcctcaaagatcaccggatcctgaatatgccaccgatagaagctgcgctggggcatctgatcgtcgttgtggtaatcattatgcaggaaggtatcgtgatgggaatagtaaggatagcccaaaaacggcgtgcagaaggtattttccactgtgcggccgtttttctgcgttgcaaagctccatgccccgccgaagtaatcctcggttccggtcccgcagatggtaggatattcctcatccccgtcaatatagaacttcacttccccttctccgtaccagtacctctccagggtggttaacgccatataggttcccacatactggccgcgtcccttaacaccgtccagaatcacataatcctttgccttctccgtaaggcgctgacgcctccagacggcatgaaaatatcccgtctctgccggcagctcatccagcagacagtaatccacctgataaaaaaatgcatttaccgcctcgtcacattggttttcgatggaaatcttcgccttttttccgaaaggcatggaaaaataggaattaaagcctctggtgggattcactgctatgggtagggaattcaccggataggataccccgaagccacagcagaaaaagtctcccaaagggctttccacagaaggagtctcctccccgtcccaatacatccggagcaccagatcccgcaggatataacggttcctgtcgctggtacgatccgttaccgtaatccatatatgctgaattacaccggggccgtccatctccgcaagcgtcaccgtttctcccggttccaggcagggaatacagggtgagcctttccgggaaggccccagatcactggccgccatccctccttttcctttttcaccggtccggttctcccagttaatcgtcctgcttctgccttttctgagcagcggcagggaatccagacttcccataaacatatcaatgtcctcctttttaccttacctgcttttaagaaagcaggcagaaaatactgcctgcggttattcccgcgggcaacaagccaaacgggcaatttatgaatcgtttcatattgttttcatcgtaacatcggggacagattttgtcaatccttattctgcagacagccgcctgaaaattaagggaaccgttgaaaaggcatcctgccggctctgcgccaggatgccttgtttttttactttctgcggataaccttctcctccgggatttccttcacgcaaccccttcccgatcagcgaagcagggaatccttatgccctttcctccgtttgcatacggaacctcacatacataaaataccattccatgacagggatcttataataagggcggaaggtccttacctcctgcggataggggcatacatgtcccggcagggtacggaacagcatctccttttcatccacacaggtgatccattcctccggcttttccatatccccgtcaaataaggtcattttatccgccgccagcaccaccgggccgaacatcagcgccgcaatgtccttatttttttcatcaaccggcttgaatgccaggctgaaaggacaggttacggtaatcacatcatcctcctgccatacccgctccaaaacagcccagctgtccggcaacggctccaggcccgaatcctctccgttcacgagaatgcggttttctccctttgcccagtgggggatccggaaagaaatgcggaaaggaagctctccccttgtctgtatccggaatctccgtatcggcgatacgtcctcttcggaacagttctccagcactgccttttctcccctgatggtaaactccgccctggatttcatatactgggatacgtagattccctcttcgtccgtataataaagcatattggcatattccgccacatcctgggggaacgtcccggtacagcactgccattcaaaattggccccgttgccctgaagccttctgtcctggacactttttaccgcgccgtccacaaaataatccgcataatacattacatgtccctgagaatcaatcggcggctgaccggccacaccattgatcaacatctgctcggcccaggcgccatatttcgcttttccggtaatccgaagcaggtaattgcagattttaaacacggcccatgcacagcaggaaacctcgcagctgccccaattatcgttcctgcccacaaggcctcctccgaaattgcggtagacagggcttttcctggtaggatcccaggaatccttcagcatctctcccaaaaagccttcttcttcggcaaacaggcactccgcaggcccatagccgccggttgcataggtatgcctttccgtaatttccgtataaccattctctatggcatccagatagtatttcttccccgtcacctcataggccatggccgcgctggaaaggctgtttacctgactgtaggcatgacggggccctatggctgaatctttattgttgagcttatcccacagataggtataatcccattcctgtgcaaaatccaggtatttctgctctccggtaagctgataggcacgatacagattttccggaagagtgtaccattcgatcatattattttcacacaattccggcccctgcaatccgtcccttggaatatctcttttaaatcttgccgccgcgctgtcggtgagtccggagcaataggcaaggcctttctcgtagcccagattttcatacatatccaggaaaccgcccagcagcttttcatatacataggtgtcattgcagtcgaacactttcttattggcagcggcgcattttccccatccctccgccagatataccgccttttccttcagccggtaatcccctgtcaccgcataaagcttggcaaaagctcccagcttctgcccgaaggtggatgctccgtttccgtaccagcccgtcagcccttctccgggagcctccagcccggccagtgtcctgaaataatataaaagagagtcattgggtatcgcaagataggtttccgctgtctccctgcgctgtctctcccacaggctgtttttcagttccacattccgatatcggaagtctttcaatctgtccatatcttctcccgtccgtgcgttatcgcgcactcttatcagcccttcaccgctccgatcatcacgcccttttcaaaatacttctgtataaaaggatatacgcacagaatcgggagggtggatacaataataaccgcatattttacctgatccgcagcgccctgggcatagcctccctgcacgcctcccactccgctggaaaacgcctgattcagcaggaggatttccctcaatatgatctggagcggcgcgtttttggcattgctgttaaaaagcagcgcattgaagaaatcattccagtgaaataccgcataatagagaatcaatacggaaatgaccgccttggacagcggcagaaccacctttacaaaataattgaaatgggaacagccgtccagcactgctgcctcatacaaatcctccggtatggaattttcaatgaatgtcctcgcaatgatcaggttataggtattgaccgccacaaatatgatgagtattgttttggtggatatcagccccagcgaactcaccgtcatatagaggggaacaagcccgccgctgaaaaacatggtaaaaacaaaataaaacatcaccttgtttctcgccttgaaattcctcctggataaggcgtaggctgccggcatggttaccgccatattcaaaatcgttcccgccaccacataaaggatggtgttggcatatcccatccagatacgggcgtcatccataatctgctggtatccgtaaaaccggatatccttcggcaggaaggtaacctttcccaggtttaccatattggaattgctgatggaagcaataataatgaaccacagcggataggcaatgataaggaataccagaatactcaggatgaggacggctgcgccgaatattttatccggccagttaaaggattttttcccttctgtcacaggatttttctttttatgtgccatattttccccctcctacatcagtccggtgccggttgtccgtttggatatatagttggttaccagcaggaatacaaagttgattaccgtgttgaacagacccacagccgcgccgaagctgaactgggaagatttgatgcccaccgtgtacacataggtggaaataacctggctcgcccccagattcaggctgttctgcatcagaaagaccttatcgaaccccacattcaggatattgcccatattcataatgagcagaatcatgactgtgggcaggatagccggaaaatcaatatgtatcattgtctgccacctgttggcgccgtcaatcttacatgcatcgtacagctgtgtatccacagaggaaagggccgcaataaagataatactgttccatcccatggtctgccagacgccggacagcacatacagagggacaaaacaggattccttccctaatatgttcgtatccctggaaacgatatgcaggctttttaaaaagttggctatgacaccgctgtcattggcaaacataatattcagcatggataccaggaccaccacagatatgaaataaggaatgtaaacagtggtctgtaccgtacgtttccatttgggactgcggatctgattgataaccatggccagaataatgggaaccggaaagccaacgagaatgctggtcgcagaaattacgaatgtgtttttcagagtcgtccagaacatgggactctcaaaatactgtctgaaatatttcatccccacgaattttccgcctgtaatgccggctgtaaagctgtattcacggaatgccagctggatgccgtacatggggacatagcagaagatcaggatatacagcatggcggggaacagcatgatccacaattgccagttatgccggatatattttctgatcccccgatttgccccgtcagcggcattcttatcaggaactgtcagtcccttggacttcacgctcatatgatcacctttctttcatacagaatgtgggatgtaaaaacacatcccacaattctgttaatctgtcctttttgaagcttatccgtatttattttcccagataagcatcaaaagccttctgtctgatttccagtatctgaggaagtccggcatcattgacatttttcacatatccgtcccagtcggcatcaatatccgattctcctgtcatccataaggaccagtagttatcgataatattgttgatattagcctgcgtgagagccattgtattctgatcctcctccgaatatttcataaacatctgaggataggtatctgattcgcttgctttggcgatcacatcattatatatttttctttcttccagcgcataggtcatatcttgagccatttcgatttccgtatctctgcggatatacatgggcgcattatccgccatggtgctggtccatttccaggtaccgggatccgtgtcgggatccaggggatccagaaccttgaagctgttgtcgccggtctgttccacgcagccgtcggatatcccgccgaaaagtccctgtacggaaacggccggatcatagaagcagtcgataaaccgaacggcagcttccacattcttacagttcgcgctgacacagactctgtttcctgacatattcagaccggtatagtcatctctccagcgtgtatcataggttccgggttcacagtctatatcgtactccaaagcgggtacgggtacatactggctgtaaagggtaggcccgaatttatctgtttcctcccagccgaatacacatcctaccagggcgtctcccttttcattcccgcgggataaggattggaatgcggaataatcattggaaattgcattggtattgatcagtccgttggcataaaggtccgccacatatttcatgaacagcttataccgctcgtccactgcatagcacttgatctgaccatcttccgcaaaataagcatccgtcccccagttggtaagctgaattccgagagaacccacaaggttggtcagggagtaggcgctgttaaaccagccattattggctccggcattgaaatccatgggtatttcatcgcccggatccccgtttccgtttgcatcctgttccttaaaggccataagcacgtccttcagttcagaataggtcgtgggcacttcttttcctacgttatcaagccattctttattaatgaacataaccgtattggtggaaggccatttcccctggaatttgggaagtccgtaaatctttccttccattgtggttgccaatgttttggtatcaggctcttcttcaaacatcgccgtgatattaggcgtggtttccgcacttatgtaaggagtcagatccataaacagtccggcatatttggtgtaatcggaatctatggttgcgttaaacaataaatcagggacatcccctgccgcaaaacgggtggattttacggtttcccaatcggcccggatctgctcccattcaatttccactcccgctttttcttcgatttcggacacccacttcatatccgtgatatccttagtcagagcgtgggatataatcagcgctttcagcttcaccacttcgcctgtggatgcggtatcctctccgcctcctccatcccccgcaggagcagcggtttccgaattacctgtactgcctgtcgtgttgttcgtacttgaactgcttccgcagcctgccagcagtcccgcaagcatcgctgcggaaagaacaagtgccaatactttctttttcattctttttcctccattctttattttgaaacttcacgattatcgtgttatttcctcttttataaagctctatattctgtaaaacgtctggttttctcttgcggatttccttttgtttttccgtttcctgcggttcatacggattcgaaagtgtaaaataatgaccatgctatttttttcacacggtacaaatattcatcttattcactatgttttttaattatcagctgtattttttcacaataatcacatatgtgttgtagcctttatgtattttttatgggtatatcttataattacatttacttttcgtaaatgtcataaagatacattaagtgtaaaaaggttatgggttcctttttccgcaaagaaacccacaacctttttacaccaaacccaacctttatacaccttgtatattttaccagctttttatatactatttttatgcattatttactattttccattttattccatctataaattacctgttttctgcctctcctgtaaacatcagatttaattacgtcgactatgaaacagtattacagcatatacaagcggtgggatttcctatataacaggataaagatacacctgtggtgttaaatttcagcttaacacatgatattttccgggtcggaattgtgaacatcaatactttcagaaaggagggtgctgttgaaggcctatgaatttacaatcgataaacctcttgaatatgtctgcaccggtaaatttgaagcgctctctcctaactggattcatgaaaccgccgatttgacggattatgagctttttgtcatatccaaaggccctttatacatctcctaccagaaccaggactataccgttaatacaggtgaaactctccttctccctccgggacagcctccccttgacctgcgccgcggcttcaagccttccgactgcagcttttactggatgcattttatctccgcccatccgctcacccctgtaactccggaagacggttccccggaaacactcggctatctgacggaaaataacatccggctccttattccccaatattgcaggacactgaatacggaaaaaatcatcgttctgatgaagcagcttcaggatgccgtccgttccaattatgaccgcctgaccattaattacatgaccactctggttatgtgtgaaatccataaccagcacctcaagcagctcaatatgggagcgcctaccaaaacccagcggcagatgttccaggatattctggattacataaaatgtcatatccatgaaaatgtgcgggtgtcggatatcgcccgctgtttcggatacaacgaaaagtacctttcccatatgttcagttccatcgcaggcttatccttaaagaggtacataatgaaagcgaaaattgatgaggctaatttcatgctcaccgatacgaacatgacaatcctggaaatcagcagcgccctgggcttcgccgacagccataattttatgaaattctataaaaaactcaccggcctgactccgagtgaataccggaatgccttttcaaaacggatgcttttccatcaataaaatctgacagacataatttatcctcagcctttacaacagaacatatattctgtataataaaaggcaggagagtgatatttatggataagaacagggagtattttattattgaaaaccacagtatcattaaaaaagtacgtattattaaatttatcggcgggctttatacaataaatatcgaaggcacctcaaagtatttgcgggtacatccaagcagaatttattccacctatacggatgcctccggggccgccggttcagggaaaaacaagtatggaacagagcggatgaagaatgggcaattactgtgaaaattgttatttttaaagtttaatttttgcttaatttccatcatttttatctttttcaggatataatgaagatgaggtgatgagaaaattatgattgatgttttagattttctgttaggtgtttttgagtttggatatgatttatgggaatatgtcagacgcaggaaaaagacgtgatcgatgtactgacattttatatttgtgcctatactgcctggccggcccctgttttataatttccggagctggagacaagctgtgtctccgaatatataaattcagagacacgttatttcttcactgcatttctttactgcataactgcagttcctattccggccgtacaagtatctccgccacctgtaaatcggttctcgttggatcttcctccataagagcgacgacctttcccacataagaagcatctaattccagattttctgcaatcatttgtacattaaggttcttttgtctcttcttacgtattatggcaacaattttggactcgccttctgcttttccatccgctaatccacgttccattccatccttaagcaacatttccccaagcttcgtcatagcaatcatctcctttaccctgtccaattcttgttcctgcaaaaacttatctgccaaagcatatagtaccgcctgcattttttccaattctatttctgttacggaactggaggcttcccggaggatatgcagacttttaataatacggtccactatctccagctttcctgacataagaggggttaaaagcagcggcaccaaatctgctttatccagtgtttttccctgtttttgtttttcttccagctgctcaattacccgatccgcatccttgtttttcagacggatcaccttcacctgataactattaatcccttccgtcagtttacttagaagctgctttactccggatgtacagattacgtaagtaataaccgcaacgttaaagctccggctggtagctgcttcgtattcccggaagcgtcttaaatcttccttcgtaacagaatcgctttcgaactccaaatgaatccagctcccggacgccgaaatataattgaaatcctgatacatctgccttgcctgcagttttacattttcagtcggcgcgatgtactttaccctgccgggtatgccaagtatcggcagtaattcatccccaaagtactgtgctgctgttttcagcaccagatcctcatggttcagtcccgtcctttccttttgttcccggttctgcccggcgggccttttttctttgcgttttttcacatagcctcctattccgtaagccatgtgtaaatttctatcttccacataattataactgataatccgacaccggacaaccgtctcttactcttaccttctttactttttatgcttcactggcgggaagcatccctattaataaagcttctttgaaatcattgtccgacatggacagaataaatgaatggatctttgaagtgttattgtaatttggctgcggcagatagtttttacacatatttccggccgccggtgtttatttatcatatcatataattattcttcatgccaataaaaaaaatcggtaaacggatgaatacatataaagttcttagcctgttgtttttgggcggttcatatcccactgcaccggttacctacatagatagaaataacaaacaaaaataataagcctaccttcatacttagcagacaaagtaggcttatcataccctagaggctaccacttttggggcggttgctcctatttgtattatagtataattttattgaatttaaagaatttcatcccccgatttttaaataaggagtatcttaaccacagccattttgacagtttcccagtatgtatgggttcgacaattcctgtatttctggcatacttttcatatcagaaaatgggaaggaggtggcatacatgtcggattgctaatcaccgttaaggctgacttagcggaggcgagctgccatttccaaggtaaacagcgcaccttcccactcttcttccggaataatcatcttcataaattcctgtatctctttattatagacgcagtttgtttttttctgtttcagatactccgaaaaatggcattcaagttcctggctgttcattataaaagaagctatattttccagcgcggcaaattcccattgtgtattatctttccaaattacagactttaatccgggcagcggattatatttgtctctcaaccgcttctgttcacttaaaagttccagcgtcattggctcatctttaggaattcccatacgtataaactgttcttcaggggcatcattctccttcatcattgctgccatagcattaatcagttccacttcttttttcggattccaaacaggttcttcctcctggggatccttctgcagatcatacaggacatccccatacctataacatgcggcaactcctccccattcctcactggcaggtatagcaagtacaggacagcccttagtgaaagaaaaaggggcatgcagagttgcattctgcagcctttccaccggaagtcttgccctcattaccgtaggcataagagtgtactctgtaagtggatcatcctctttccgatgtggtgctctcatataaagaaatttaccatcagtgatattaatcatggatccgaagataccgaacaaaacataatcatggatctttttatcatatgctattgtattttttaatggttttccctgcatatcttctggaattggtatattgaaatattccagtagcgtaggtgccagatctattgtctgtacaagagactttctgcgttctccactttttttgcaacgaggatcccatataaataaaggtgtgtttgccatttcattatataaaggcataaccccttttgcccaccaaagatgttctcctaacataaacccgtgatccgtattcacaataagcatggtatccttccacatatcatacttatccatcatatccagtaccttgcccagatatttatcacacatggaaagcagcgcacggtatttcacccggaccttacgaactgtatcctctgattctgttaccggcccatatggcggccagtccagttgtccgggttcttctcccaggttctgatagatttcctgaaactcctcaggggaataaaatggttcatggggatcaaaggtttcaatttgaaggaaccaattatcatattcccgattcctttcaataaattccaacccctgggtaaaagttctggcctgaggaaaatcctcttctttttgtataaatttccgattaatgctgtcctggcgcctcatgttggcgccgataccgcctgtaggcctgggtccaaacgaacttttatgttcttcctgtggttccagtgatcccttccagggatccccctcctgccctcggttgcattcccatgaactgtatctggtgtgataggtagcccctccatcttcccaataatgctgatgatcggatactatatgagtatagatcccattctgcttcataatctcaggagcggaatcatcaaatggctccagtgggcaccagcctctatgaagaaaattcagccgtcctgtatgtaattctctcctcgcaggcatacagggaaggcttcccacataggaattatcaaaagttactgttctttcccccagcctctcaaaattaggcataagggattccctgcatccataattgggcaggaaatgtcgatttaaggaatcatacattaccataattgctttcatatcaataacctttcccgcagtaacaacgggtcctttaatcttttcttttcagtctataatgcaataaatcagtttttcattccggaagaaacgattccctgtacgaaatatttctgggcacatgcatatacaatgaccatgggaatcaccgtaataagcgtcgccgccattaaataattataatgagtcatcgaacttcctctgaacatctgcagaccaagctgtactgtcttcattttttccgattgagtcatgattaagggatagaaaaaatcattccaggtggctacagattttaatattgtgagtgttgccaggattgtttttgagagcggaaggaatacataaaaataggttctaatagctccacagccgtcaattctcgcagcatcatccagcgattccggaaacgaagaataaaactgtctgcataaaaagatcccaaaagctccagcaagaaaaggaacaatcaacgctacataagtatccagaagtcctgtacctccctgtcccagaatattatttcctcctgccagaggtaccgatcgcatcatcacaaattggggaataataatcgattgtggagaaaccatcattcccaaaagtatgatcataaacaatatttctctccccttaaatttcagccgggcaaaagcatatcctgccatagagttgaaaagaaggcttcctgccacagtaattacagtaataagcagactgtttcggaaataaagcagccaatctcccatcagaaaagcctggcgaaaattttcaatataggtaaagctggatggcagccaccgaaaacttgccatagatatttcgggatcggacttaaaagcggtcaatatggtaaatattacaggtatcaacgtaataagtacccatatagacaatataaaataactgattattttccctgtcaggctttttttctttttccccattttaactaaggtcattctcatcgccccttccataacgcatatttaccagtgtaatagcaaatataatcagcattaaaataactgcctgtgcagatgcataacccatcttatagtattcgaaaccattcctgtatatctgatgggcaattgttgttgtggaattcagaggcccgccattagttactatcagtacctgaccgaaaacctggaaggagttgatacatgccatgacaaatacaaaaaatgtggtaggcttcagcatagggagtgttatatagcagaactttttccaacctgttgctccgtcaatacttgcagcttcatacaggtaatcgggaatactctgtaaaccagagagaaaaagtatcatgttatatccggtagaattccagatactcataattgcaatggaaatcatggccattttatgactgctgatccaaggaacagctgcaaggccaagatctctcagcatcttgtttagtattcctgctgttgtatcataaagatacagccaggccatggagactgccaccatagaaaaaatattaggcatataaaacagcgttctgaaaaaaccttttccttttagtccctgatttaggagcaatgcaagcgccagtcccagaaccatagcaggaataatggccaaaacacaataatacagcgtatttccaaaacttttcagaaacagactatcgtgaaaaagtgccatataattactgacgccaacaaaatgagcctcactcagattataatcagtaaaagacattataatcgtccatattaccggtatcaaaataaagacaatataaataagataactgggggcaatcagaagataagctgcattctgctgctccagcctgcctctctttttcttcatttttctttctctcacacctgctccttccctttgctttctgccggcattaccggcagaaaaagcgaaataaaccttttatttattcaatacgctatcccagttcgtttttccctcttccagggcgtctttcggtgcaataccgctgaaactggattcaattgcagtccttaagaaagctgcacactcactaaagttaggatgcataggctttccataagagaaagagttggcatacatcgccacaatattttcataatccggatttatagctgtaaaagcgccatccaatgattttcttcctgaatactgccctgccgtttctgcaaatacttgcagtgattcttcggaaaacatatgtaaaaacatatctgcagccacttcaggatttttagtcgctgcattcactgcaagataatctccaatcaacagcgtattcatatcgtctttaacaacaccaatattaccgggaaatgcattatctgctgtcacatattcagaattggctccaatacacatggcagcaactccggacgctaatccggaagatccctcatttgcatcttttaaactggcattgccggttttataaatatcgttcataaaggtaagcgcatttatacattcctctgatgcaaaagccgcagtataatcatcttcccagaacagaggatgttctgaaaacatgccgagatatgtaaataattcctgctcactgtcaggatctacttccataccgtagacctgaacatttcctttatcatcttttacagtcattttttcaacaagcgaaagaaaatcttgtggtgaagtaatatgtaaatcttcttctgtaacaccattctgttcagctatatcttttctgtaaaaaaagttacggttagagggcttaaataatgcgtaataggaatcatccatcttacagatatccaggatattttcataaaaatcttcgtagccatcccaatcctcaggaatatattcgcttagattcagtaaattgcctgcacgctgtacacttcctatctgaccataccccagcatgaagatgtcaggaccgctggcacctgccaatccggtattcaacttagtaaaataatcactccagggaatataggttatctcgtatcccacgccctcatggttctcacaataactattcaatacagtcttataagcatcatccatagatttttcaccgcttccggcaatccagatattaataaccgtatccgctttggctgtcgaattcttttgtaccgattcctgctgtgaactttccttcgcatttgtctcatgctctgatgtagatgacacatttccggaactgttgtttccgccgcatccggtaaaagtcatcattactgctaaacaaattgctgctaccttcattcttttcatagccttttctccttctcttttgcatttccatttttgcgtaagcgctttcgcaaatattatatttatactcatctacatttaattatatagatgagtaattatacctataacaaaaaatatttattgctattttatgtgacttataaagacttattttgtggtaaagcgcttactcataatttatatatacaccaattggttatatgagtcaactgcaattactatatttctttttttttatatatttttaccaattatcaatattattttttatctattatttaaataaaactttgcgaaagcaattactcattttcattgacaatcttctttctatccattaaattaaatatagatataccttgtactctgtcaaaaaaatataataaatggaaggtattttaatgaaacctatcgataaagtaacaatttatgacatcgctgaagctacaaatttgtcaattgcaactatttcccgcgtaatcaataaaaaagggcgctattcagctgcaactgaagaaagggttctgaaagctatggaggaattgggatattctcccagcgccagcgctcagagtcttgcatcaaaccagactcacactcttggtttgatgctccctttctggaataaacgtcagcttggtgatgattttaccatgcagtttctgaatggagctactgttgccgccacagaattaaaatatgacattcttcttgataaccgttcattactctcagaactgtccgtagagcaacttattaaacgaaaacgagtggatggaatcattttttcctccgtaggatacagctaccagaatctattgaacgatttaattaaagctcatttccccaccgtttataccggaatgaaactgcctttcgatattcagggaaataacatctatggatttcatgaaatttataaaagggattttcttgaagagtgctataagaagggatatcgtaagatagccatgttcaccagtttttttcaggatcaggaattacatatgattgaaaacacacggcaggtcattgaaaatttcagaactgagaagggacttcctgaagataactgtcgtttaattgtttatgactattacagccctacccactttgaatatctgctttctgaacttttaactgagactcctcatgtacaggcaatttatatggatcaaatgtttacttgttcccgtgcctacaacatcatcaatagctttggaatgaagatacctgaggatatagcagtggtatctactgctcagtatgaaagagccggagaagaattttctcctggactcaccaccacctatgtacatgcgtacgaaatggggatggccgcagtccggcttctggtcgatcggattcaggggacctcatcctccgtggaacagcaaatcccctattcctttctttacagggaaagttttcggccatatgaacaataaagtatcgaataatcctacctgaaccgatcaggtatccaggtaggattatcaatttacttttgagcctgaaaccagctatttctctttcagataaaaacaaaagcctccaaaagataaaatctcttgaaagcctttaaaataagctgctgacgggaatcggacccgtgacctccgcactaccaatgcgacgctctaccgactgagccacagcagcatttcccggcgacactcgctgtcaccgaaagctagtatagcatagtaaaatctgttttgtcaacaataaaattcatttttttcacgagttggaatctgctgttttccttcaaattcatttcctacagcagccccctatctcacaccgccggttattccactacctgataagcaatataagcatcgtcttcaaacacgacttccatatgcccttctatccactcccacgggaaattctgcgtattcatttcatagggccataccagctcttccccctccgggccagtctgtatcttatccatcagcacataatccggatgctcataatccataaccaactccttgcctctgcagcgcagaatatggaaatacaggttctgccgtgcatatacgtcacctgtcaggaccgtatccacttccttttcatcaagctgtttaagcgcggcataaatatgattatccctgctgtcatagcccgcattatattcaggcagcctgcagtatacaacggtcagaagtatagccgctgcgactgcgagcagcgagccgtaagcagtgaatccggccggaagggaaaagcttcttctctgtgccagtctgtctgccgcaggtttaacaatggcccacagcgcatatggcatcagcacaaacatcatggacagaacgcttcccatatatgtgaatacccgcagataaggaaacacacactgtatgacgaggaacacaggaaccattaccataagcacaaatacatacagagataaaaagaacatacttttttcttttctccggcagctgataagaatgagcgcaagcatcagaagcaatccgaaaagaatgagaaaaggcaggatatggcttccgtttggatatacctgattgagcacacgtcccaggtacagggtaaattcattgttgaaacgacttctgtcaatactctggatattcggatccgaaagcattgcctccatccctctggaaaaagccgcaaacggtgcggttttcaatacctggaaatggctcatgccataaaaagcaccggtctcctccttcacaaggaaattggaaccaatggccagccagataatcgtataaaggccaaaagtcacaatcgctgccgccgcagaagcgattacaagccggaaaagttttttatattccccggtaaacagcagatacaatcctcctgccatacacacgggcaccacccagtacagattgctgggaatggtatataagcctcccgtcaggcaggcagcaaagcctgcataataccagaaccgtcttttttccttcacccctgccgatttttccggtatacagatttcgtacaggcagttaaccgccgccagaaggaaaaagccggaaagagcatatcctcttccctggacggcctgctgcactacattgtacatggcggcaaaaagagcggtgcccgccgctgccatccggggagaaattccttttttcagaatccggtacaggagcagcagacttcccatggatgcaaggaaggaaactccgcgcagcccgatatacggattccccagcttattcagaacagccgacaatgccgaataaaacacatgattattgggcagcggccaatgtatcatggaatatatcatgcctctgtcaataaagttttcataggtatacagttcatcataccagggcgggacggaaaacatacgccatatataataaattcccattcccagaaacaggcaccagaacaggccgtgatcccgtatcagcgccgctgcatccttctttttttctattgctgtatttttcacagtatttattcccacttcgttatcctttttcttattatacccttattcgcaaaaaaactgccgaaacaacggaagccgctctctgcggatccctcttatatccattcaaaaatccggcggccgtcttactgcctcagacggcgccggatcttaatatccttaatggccgcgccgggcatttcctgccgtacggcgcaattatatcatatcttctgttattaatccagttcccgcttgccggtgtaaagctcataatatctgcctttcatggcaaggagatcctcatgggtgcctctttcaatgatttcgccctgctccagcaccataatggcgtcggcatcgcggacggtggaaaggcgatgggcaatcacaagggtagtacgttccgtcatcagacggtccattcctttttcgatatgtttttcagtcctggtatccacagagctggtagcttcgtccaaaatcaggactggggccttggaaatggcagccctggcaatattgagcagctgtctctggccctggctcaggttcgcaccgtccccctctatcatggtgtcatagcctttatccaggcgcatgataaaagaatgggcgctcgccgtcctggcggcctgctccacctcctcatcggtggcatccagtcttccgtaccggatattttcccggactgtgccggtaaagagatgagtgtcctgaagcaccatggcgatattacggcgcaggtcatctctggcaatatccctgatatttacatcgtctatggtgatctttccttcattaatgtcataaaaacggtttatcagattagttattgtggttttgccggcccctgtggagcccacaaaagcgattttctgtcccggttttgcgtacagggaaatgtgctttaaaatgattttgtcggaattatagccaaaggttacatcctccaggcgtacattccccctgcagtcagtcagccgcaccgcgtccgggccatcctccggctcaggctcttcatccataatggcaaacacacgctccgctcctgccagtgcggaaaaaatggtattcatctgcatggaaagctcgttaatagggcggctgaactgtctggaatagttcacgaatacggtaagccctccgatatcaaagcctctgagcacacagaggattccgcccacgcaggcagtgacagaatagccaacctggctcagattgccgaccacgggccccataattcctccgaaaaactgggccatgatctgcttatcccgcagatcataattaaggtaggaaaactcctcttccgcaatttcctcatgacagaataccttcaccaccttctgtccgctcaccgtctcctcaatatatccgttcagcgtccccagcgccgcctgctgggccttataaaatcggcggctccgcatggtgacaaaccgggcggcctgcatcataacaggaaccatcagaacggtaatcagggtcagccagatattggtatataccatcaggcagaaggttcctatgacattgatcacgctggaaataatctgcaccacggtattattgagcatttcacccaccgcgtccacatcgttggtaaagcggctcatgatatctccgtgattattggtatcataaaaccgcaccggcagcctctggattttggcaaaaagctcgttccttattttaaaaatagcctgctgggaaataccgatcataatgcgggcctggagatactgggccacaatgccgaacagataaatacaggccatgatcagcagggaacggagcagcttctgtgcgctgccatccacggaggtcagtccgtttataatggggcgcagcatataggagccggcaagcatggataccgtattgatgataacacaggcaaaaaccaacaccagcttatatttctcttcctgtatgtaggaaagcagccttttcactgtttttccggtgttttggggctttcccccgggcatacggcctcttccggggcctcccggcccttttgccgcctttgcctggttctgttgggctgcataggaatatttccggatcagcgcttcttttctatcttccttcatgacgcacccacctgcctttccatctgggaataatagatttcctggtaggcgctgcagtctgcaagcagatcctgatgtcttcccaatcccacaattttcccttcatccattacgacaatctgatccgcctccataacggaggtgatcctctgcgctatgatcagttttgtagtttcctttaaggtgccggtaaagctttcccggattttggcttccgtagcggtatccacggcgctggtgctgtcgtccagaatgagtatccgtggctttttcaggagcgcccttgcgatacagagacgctgtttctgtccacccgatacgttgactccgccctgtcccagctgggtctgccagccatccgggaaggtctgcaggaaagcggcggcctgggcggcctctgaggccttgatgacctcttcctcagaagcgtcctcatctccccacatcaggttttcttcgattgtccctgaaaaaagcacatttttctgaagcaccatgccgacgccgtttctcaggtttttcagggaataatccctcacgtccacaccatccaccagcacgcttccctcgtccgcatcatagagccggggtatcatggaaacaagcgtcgtttttccgcagccggtggaaccgatgattcccaccgtctgtccggactctatcgtcagattgatatcatccagcactttttcctgactgtccttataataccggaaggaaactccccggaattcaatcctgcccttttgtaccagggcgtctttctttcctgcccggtcatccgtcaaatcaatctccgtatccagaacctcattgatacgctttgcactggcgatggcacgggagctctgcagcagcaccatggccagcatcatcagagacatgagcacctgcacgatataggtcgtgaaggcagtcaggtttcctacgggcatgtcacccaccagcacctgttttccgcccatccagacaacaagcagtgttgtggcattcataaaaaaagccatgaggggcatctggaaaatgaccaccttaaaggcacgcaggctggaatccttcagatcctcattggatcgggaaaaacgctcttcttcgtattccccgcggacaaaggatttgataacacgtacgttctgcagcgtttcctgaatgttggaatttactttatccagctttttctgcatcatggtaaaccgcgggaaggccgtacgcatgattatagtgatgaccacgatcataaccggcatgatgaccagaaatatccttgccaggcccgcattcatggaaaaggccataataatagccccaatcagcattcccggcgccctcagcatcatccggagagccatcataatcaggttctgcacctgggtgatgtcattggtgagccgggtcaccagcgaaccggtggaaaaggtatctatattggtaaaagaaaatttctgtacctttttaaagcagtcgttacgcagatccgcgccgaagcttatggatgctttggaagcaaaccacgctccgccgataccgcctgccatcatgacaaaagctatgatgatcatggtaatcccggttcccacaatataagggacatcccggttggcagccccgatattgatgatttttgccatataggccggcaggatcacctctcccaccacctccgttatcataagaatcggccccagtataaatgcataccaatagggcttaatgtacttcaaataccgcttcattttcgctcctccgcgtccagccggctgttctgctccgccatatttttataagccttttccataaaatgaaagaactgctccacctcttcatcggtaaatccttcaaagaagcatcggtccgtttcctgaaaaatcagaatacttttatggataacctcttttccttttgccgtaatgctcacctgattaatccggttatcattctcgtcggcaagtctcgtgatatatcctcctttttccagtttcttcagggaaacggcaatcgccgctgccgaaacatcgaatttctcagccagatccacctgggagcagctgggatttctgtccagctccattaaaagtctgtgctgggtggggaaaactcctgtgttggagacttttctgtccaggtagcgtctcagcattgtatctgttttgcggaatctcataatcgaatcatgtgccagctgttttctgtccatcttcctaataactgcgttgcggcagttcctccttaatgatctttttaagttttgtgagagcctctgtgccctccgggtgctggttccaggcctgtgcctgctccccccgtctgcgtccctgagcttcccgccgccggccccggccatgcaggggtccttgcaggggacgctttcgctcggataagcacgcagcggtactaaggctgcaaaggacgcagcctaaggaccggcgagcttatgacgccccttacaggattccctgcatggccggggccggcggcgggaagctcagggacgcagaccgggggagcaggcaaaggcctggaaccagcacccggagggcacagaggcttgcgcgaagtttgagtaactcagttaagtagttaatgcttaaataagttaattgttatctagttaactattttagtattttttttagggaaagtcaagtcgttagtgattttatgtgtcaggatataccagtactggaatgggtataagttgtggaagcggtcttgtcacataactagatatagtatataatagattcaattcggcaaaaataatactagttttagtagtgtacatatccgggtatattgcatttgccagacaacaatctacgggcccggaaaaaggagacagacatggatatcatgaaacgaaatggccgtcaggaggattatgacgggcagaaaattatcagggctatgaggaaggcttttgagagtacgggaagtaatccggcgccttcggttatggctgatctgcttgtatctgttgaggaaaagctggcggacaaaaatattacgaatgtggaagggattcaggatcaggtagagcagactttgatggagcagggcttttttacggaagctaagaattatattctttatcgtcagaagcgttctcttttgagagatgccagggtgtctctggggcaggcggcttctgatcctgagctggaatcggtgttccggaagattcagaaggattttccggaggaggagtattctcttcttcatctttctgttaaatataatgctttctgtaaaccggaaatgaagccggatgagaagctgtcggccttgattaaggcggcggttgagctcactacgcaggaggctccggggtgggagttcattgcggccaggcttttaaattatcaggcgcacaaaaagatcgccctgcggatgggggaagcgagaattacggggttttatgaaaagctccggtatcttacggatctggagctttatgggagttatattctggagcagtacagccgggaggaaatcgaggaggcggcattgctgttggatgataggagggatgagctgttcacctatgcggggcttgatctcctcctgaaacggtattgtatccgtaccaaaagccatgttctcctggaaacgccccaggaaatgtatctgggcatcgcccttcatctggctatgaaggaaaagcagaatcgtatgaactgggtgaaaaaattctatgactgtttaagccgcatggaggtcacgatggctactcccactctttctaatgcgcgcaagccctatcatcagctctccagctgctttatcgatacggttcccgacagccttgacgggatttaccgcagtgtggataatttcgcccaggtgagcaaattcgggggcggcatggggctttacttcgggaaggtacgtgccacgggaagctctatccgcggtttcgagggtgcggcaggcggcgtgatccggtggattaagctggtgaatgataccgccgttgccgtggatcagctgggtatgcggcagggtgcggctgcggtttatctggatgcctggcatcgggatcttccggaatttcttcagctgcggacgaataacggggatgaccgcatgaaggcgcatgatatttttcccgcggtctgctatcctgatctgttctggaaaatggcaaaggaggatctgaatcaggactggcacctgatgtgtcctcatgaaatccttaccgtaaagggatattccctggaggattattacggggaagaatgggaaaagcgttatctggaatgtcttcgcgactcccggatttccaaacggacggtctccctgaaggaaattgtgcggctgatcctaaaatccgcagtggaaaccggaacgccctttaccttcaacagagatgcagtcaacagggccaatcccaacgggcacagaggaatcatctactgttccaacctgtgtacggaaatcgcccagaatatgtctcccattgaaacggtgagttctgaaatccgtacggaaaacggggataccgtggtggtgaataccacacgtcccggggattttgtggtctgcaatctggcgagtctttccctgggaaatattcctgtggaagatgacgcttatctgtccgatgtggtggcaacggctgtccgcgccctggacaatgtcatcgacctgaatttctacgcccttccctatgccaaactgaccaaccgccgttaccgcagcatcggcctgggagtaagcggttatcatcatatgctagccaaacaccagatcccctgggaaagtgaaaagcatttttcctttgtggacgatgtgtttgaacggattaaccgcgccgctatttccgccagttccgatatcgccgcagaaaaaggcagttatgaatattttgaaggcagcgactggcagaccggcgcctattttgaaaaacgcagctatacctctccggtttggaaggagcttcgggaaaaggtggcatcccagggaatgcgcaacgcctatcttctggccgtggctcccaccagcagcaccagtatcctttccggtactaccgcagggcttgaccccattatgaaacgctttttcctggaagagaaaaaaggctttatgcttccccgggtagctccggagctttccatgaaaacctactggtattataaaaacgcccatctcatcgatcagagcatgagcgtccgcgcctgcggggtgcgccagcgtcatatcgatcaggcgcagagcatgaatctgtacatcactaatgattatacgctccgtcaggtgctctccctctacatcctcgcctgggaatgcggtgtcaaaaccatctattatataagaagcaagtcccttgaggtggaggaatgtgaaagctgctcttcctgacggcttgtgaaaaggataaaggacgtaagaaaggatacaagaaaatgaatgaactgaaaaagaaacctctttttaacccggaaggggatacggacgtgcgcctgcgccgtatgataaacggaaatacgacgaatctgaatgatttcaataatatgcgttatccatgggtgagcgactggtatcgtcaggccatgaacaatttctggatcccggaggaaatcaatctctctgcggatgtcaaggactatccacggcttttgccggcagagcgcaccgcttatgataaaatcttaagcttcctggttttcctggattccatccagactgccaacctgcctcacataggggaatacatcactgcgaatgaggtgaatctgtgcctgtccatccagaccttccaggaatgtgtgcacagccagagctacagctatatgctggactccatctgcagccctactgagcgcaatgccatcctttaccagtggaaggatgacgagcatctgctgcgcaggaatacgttcatcggaaattgctacaatgaattccaggagcacaaggatcccaccaccctgttgaaggttatgatggctaattttatcctggaaggcatttatttttacagcggcttcatgttcttctataatttgagccgcaatgggaaaatgcccggctccgcacaggagatccgctacatcaaccgggatgagaacacacatttatggctgttccgcaatattatcctggagctgcagaaagaagaaccccagcttttcaccgccgaaaccatagccgaactgaaggaaatgctcatggagggtgtgcgccaggaaatcgaatggggccattactgtatcggaaacaacatccccggccttaccagggatatggtgtctgactatatccgctatctcggcaacctgcgctggaccagcctgggctatgagcccctctatccggagcataccgcggaaccggaaagtatggcctgggtgagccagtattccaatgcgaatatggtaaaaacagatttctttgaagcgaaaagtacggcctacgccaagagtacagcgctggtggatgatctgtaaaacgctctgcaaaaaaatcggccggtatctgtcagggattactcctcagataccggccggttctttgccttattacattaaaaaagcagcttatactccgcttctgccgtcagcctgtgaatcctgcacgccccttcctcaggcagatccggccattgctccaaatataccggcatatctcttttcagtctgtgaacggttatatccacgttctccggaaatccaaatcttttcaatccgatctcccaaatctgtcccgtataaaaatgatccccttccttcttcccgtcgataaaaagctccaggctctccccgacataatccagcttcaggaaaacatcctctgcctccgtttcttctgcataatcaagttctatgcggtaacggcattcttcatcgctgctctgtttttcttccttttgcaaattacaggaaggcgtattccgggatattctctgggaatatcgtgtgaaaatcccctcgtttcctgtttttacaaatccccggggtaccgtgggaagctccggatatacacggatttccagctcttctgtttctcccgcccggaataataccttacaggaaccgccttcctccacaatcggatagttacataccgccagatattcttctgttccgaattccatcctccaggcatgcagcgcatcctctctgcttatatgaataagttcctttttcccaagatctccttctattctgaaatgaggttccctgtcaccgtaaaagatatatctctccccgtccgtcctgtgaagaatacacaggggagaagcgcttgcacttatcaataccgcatgttctcccaccggaaggtgaaagggatagaaaaaataatctccattccggatatcctgcgcctcataagagatatctccgtcaggaagccggacattcaggattaccccctgatgatctgccatctgttttcttctctgataattatttacaaacagataaccgctgtttccttttctccttaccgcactgcggaggcggacggtatcattgggatcctgagggctgtcctccggaataaaggtcttcatttcacagaaggcttccccgaaatcatggagaaacatggcatataatttaagctccaggccggtatccgatatctgtccgtattccctgatgggcgcgttaaaatcatacgaatattccggaagatcgttgggatagcctgattctctggactcctgaagcgtgctccttttcccatgaggattggttcctccatgatacatatagtaacccagaagattggctccgcaccccagcttggtcagtgtcatggccccgatatccgccgctgccgccaccggccttctgtgccttgtcacctgaattccgccgcccagctccgctgtgaggtacgggaacttatcccacggccaggtaagaccttcccccattcccaagtcactgcctatattccggtcgtttctttcctgggtaaaaacataattcacactcggctccagttccgttattctcggatcccatggtgcgtcgcaataacctcccagaaccggaagcatacctcctgtaaccgctccgccccagccggtagccgtataatagggtacatcaaagccggcaccgacagccagccgcttcagccggcgcatgtggtcctctccctcttcaccggtaagaccgccgcaatgtccatactcattttcaatctgaacaccgattaccggtccgccgtccttatggagaagccctcttacttccataaaaactctctcgtaatagcgttttacgcaggataaatagctttcatcattcgtacggggcacaaaatccttctcaagcagccagtccggaaatccgccgttacgaacttctccatggcaccatgggccgattctcagaaaaaccagcaatccgcatttttttgccgcgtctaaaaatttatgaagatcccggcagcccgaaaacaggtattttccttcctcttcttcatggtggatccagattacatacgcggataccacatcgacgccgcagaccttcatcttatacaaagactcttcccaatagctgtccggatacctgctgtaatggaattcccccattacaggaaaccatggcctgccatttctggtcagatattctgaggtataggaaaacaattccgtatttttcaacctcatcacctccctgtctatttctgtagggacggccaggcaaattctatccctaatttctctttgtttttatggaatttctcattctgggattcatacaattcttcatagcccatgctgtacatctgctccacggcctggttgtacagcttctcgcattccacttcatccgatgccataataatctgaggctccgcagatttccagtattcatcaatggccgctttaattgccgccaaatccgtgcctgccatagggttaatatcggaaaagcatttgtcgtcgtacaggctggcatccttatcacgctccatgtttatccggtctttttccagttcattttcaacgttaagattctcgtacttctggatgatcgtgtagtccatggcaaaactcaggttcatattatacttattataagcagcattgtagtcttcttcgtactcttttaccgcttcttctttccggatcgccttgccgtctacgatatcatagcagccgcttccgtattcctcatccaaagccgcttcttcctgtgtgagataagcgaacagactgataatcctgtccgggtgctgtgcaccggaggttatcatggtcgttgtccagcctgccgcattgatagatgataaataatgctgtttgcccgaatcacctgttttaatggttccgcagtaaagcattttcgcattgggatcactggaatagagagccgatcttggctgttttaccgtcatccagccctgtgccataaatacctgcccgctcgccactttctgatcccgctgtgtctgatcctgggtaaattcatccgtggtaatcagcccttccgtatacagcttgttatagaatttcagcgcctccaggtattccggctggagcttgatatccaggagattcccctgttcgtcctcctgctgtgccccgaactgctgtgccatatttaccggatatacacccgttaacggaataacatccatgccgtcatactgcagcttctggtcttttaccttcttcagagcctgataaaagccgtccttggtgtgcagatcatccattgtcatgccaatctgctccagcagatccgtgcggacaaaattgctgttatgggtgaccagaaagccgccgaattcatcactgcatctctccggcccgtaataaaagcttaccagggaataccatttcccatcctcatttctgtaccagtccttctgtgactggggaacattcaaatccggcgcatagttttccgccagctcctccagatccagtaccagacccgcattctccatctgcagcctctgggatgccaccgcatcaaaggttaccacatccggaagttctcccgatacaatcagcgcattcagcttatccgcatcgcctgtaatgatattcacagtgattccggtttccgtctgcagttttttgtcggcaatattattcaccggatcaaaaaccttgccataccagtcataagccacaaaccagtctatggttacagggcttgtgtcctttttccagctcggggtttctcccgctgcttcctcattccgggactcctccgccgcctccgtctgaagcgcctcggactgcgggatatctgccgccgtctcttctcccctgcttccgcagccggacagcaggcttacacataccgcccccgcaagcaggatactgctgattctttttcttctcatacgcaacctcccataattaaatgattataattaaccctttaccgctcctatcgtcataccctttacaaaatatttctgaaggaacggataaacggcaactaccggcaatgcagtgaccgccattgcggccagtttcacggactgggcagtaattttggcggcggcgtccgggactaccctggccgccgtggctcccattccggcggcaacggacggatccgtaatgacctttttcaaatacagctgtatcgtctgcagcgatgcatccgccgtatacatcatggaatcaaaatagctgttccagtgcccgacaatcgtaaaaagagaaatggcggctataacaggcttgctcagcggcaggattatctgcaggaaaatacggtactcccccgctccgtccatcttggctgactcattcagcgcctcgggcagttctctcataaaggactggataattatcatattccacacattaaataaggaaggaatgatgtatacccaaaacgtgttgtaaagatggagccctctaatcagcaggaaatagggaatcagcccacctccgaaaaacatggtaaacataatgaacggtatatacacctttttaaatttcaggttcggcctgcacagaccgtaagataccaggcacgtaaacagcacgcttgtcacggttcccaccgcacattttgctatggttacggcaaaggaattcaatatacttttgtccctgaatacggctttgaaattatccagagtccatacacggggccacagatatacgccgccccgcatataatcctttccttcattaaatgcgcccaccacaataaaccacaggggataagccattatcagaataaaaagaatcatgatcagcacatctatcacatcaaatggttttattttaccggcctttcttatttcctccatcatttcctcccccttcctaaaaaagtccttttcctgttattttgttggagcatttattcgcagaccataacaggacaactgcaattatggatttaaacagcccgaccgctgtggcgtaggaatacctctgctgcgtcattcctattttgtatacataagtgtctatcgtttcgctggcgctgatgttcagggaattctgaagaatcagcacctgttcaaagccggtattgagaatattgctgatttgaaaaatcagcatgattacgatagttcccataatggccggcaccgtaatatatatgattttctgaaaacggttcgctccgtctatgtatgcggcctcatacatatcctggtcaaccgaagtgatggcagatatgtaaagaatcgatccgtaaccaatgctcttaataatggaaataaccgtgaatatcatataaaatttattcggatccgccatcagattcatgtttccttcagccagccggaataaattcagccctttatttacaatgcccccggatgccagcaattccagcatgattcctccgaaaatgacccatgacagaaagtggggaagataagatacggtctgcgccagtttacggaaccgtctccctctgagctctgtgatcaggatcgccagaataaccggcgccggaaaacctatgacaagacccagcagatttatcattatcgtgttcttcagcaccagaggaagcttaggatctgtcaggaactggctaaaatatttcaatcctacaaaatctccgccgatgaaccccgacataatgttaaaatccttaaaagcgatgctgattccatacatgggcaaatagctgaatataaacaggaaaatcagtcccggccataccatcgactgtatctccagctgtccctttaatttttcccggctcattctgccggatcttttcctctttgtcttccgatccttttttactgttgtcactgccattcataccccctgtttctgtcatcttccgtaatcttttttccctgactgccgctgtccaataatcccataagctcgttctgctttacctccagagcccggcagatacaaagcagttcgcttccgctgagtgcctctctccatacaaagaccatcagcagcctccggtatgcaattcctgtcagctgtgctaatgaagcgcagctgatatcctttttactcatgatatcttctaagaattgtataattcttttgttcataattcataccctcagattgaattattcgtttacctcatcattatatggttgatttattcgttttatcaatatattttgtttgaatttttcaatttacaaattgacttgtttaaaaccatcctgtattatgcagttgtgaggtgacaagtatggcaaataaaaaatttggtgatactcttcgtactttacggaaagtaaaaggatatacccagcagcaggctgccgatttactgggactgaagaacaaaagcacacttggttcctgggaggttgggaaatcagagccggacggttatacgctgctcaagctctgtcagatttatgatgtgcaggatatttacaccgccttcggagaaatttctccatgtaaacgctcctccgacagcataatggagcattatcttttactgacggatgaatacaaaaaagtgattgaatcgctgattatacagctgttggaaatacaggaaaaatcaagataaaaaaagggccagtgatatatatcactggccacctttccgtatatgactgcccgcagcgtattttatcgtatcatttgcttccattttatccacaattcccgccgcattgactcccggatgagtcacccggatgcggcatacctgttccacgaaattctccggcagcctccatttctccgccatcatccgaatactttcccctctgtccatccctttcatgattcttttgaccgccacgcctctctccagagtgtatatctcctccagattggtgtttttcctgtcaggcgcgctctcttccgccagcggcagatcaatccgctccacctcatagctgccgttatggagttccaggaccgccatggtaatcggaaggctgaaccgccgtttaccgcagctccccggattaagccacagggtatttccctccttctgacaatcataattatgggtatggccatatatgatcacatccgcctctcttcttacttccgggatttccctcttattatgaatcatataaaaagagacgccctccagttcaaaccagagtgtttccggcaggccggaagcccattccccatcgttgttcccccggacaagatataaaggcttctttttttccagctgttccgccagcttttgtgtatttacatcccctgcatgaatgataacatcacaggattccataatgtctgtcacttcctgccgaagcagatcatgggtatctgaaataactgccgcacgcatttttatcctccctttccctccggaatcgcttccggccctaatcaaaaactgccttttgccatttcaaattcttccagaatactcctgcctatatccccgtaatactcctgtgtcgggccaatataaagcccgtttgtgctgcagaaagctccccttgcctcctgccattcattttccccttccatcgaaattgcaatacattcccccttctcaaaataaagggttctggcctgcacagcgttagtcggcttatcaaccgcatagatcaattccccgctttccttgctgaagtaaaaatcataatggatgccttccccatgcagcagtttgtccttctgcgccagtacctgctccacatagtccctgttatggagcgccgagcagctcacatttgcaaggattagaaaacctccgtccttttccttcaggctaatctcccaaaacccgtccccattcccagtgttataaaggattttcactatatccgccgttcttgtccccgacacgcattccgccataaccagattggtatcacccacattcagataataagcctggtattccggcagataatccaaacggattttcctctgcacctgatccagggtaatgccgaattttccggtgagatattcgttcatcctttccaccgggaattttaccgaatcaagggtttcctcccagccgagctttctgatttcctcctcagacaccggctcccccaaatcaaaccggctgtaaaaaatctcggaaacgctgatctgttccggttcctcatagcagcaggtcagacagttcctgttatcggcgctgttcaaaagctcctgaaagtcctgcagctcctccggagtgagcgaaacctcttccgccgtcttatccatacaggaacttagggtaaataccgcacaaataagtaataccgcagccaacatcctgcccggtccctgcatcctttttacaccctctttcatactctccattttccgtaatttcctccctgatattttttatattaccttttttcggccatgaaaacaatgtgcagaagcgtattttaaaaaaatcttaattgtttttgtgacaaaatttactttcgcaaaagtggcatggttaaaaatatataaaatggtactttttatcatgccacttttatgtataataggatgcagacacaaacccataaatggattacgtttcgcgagcgttcctgtaaactgtatgtaaaagaggtaatcattatggataataacagatatgaattgaataaggaactcgctcagatgctaaagggcggcgtcatcatggacgttaccacaccggagcaggcccgtattgcccaggaggcaggcgcctgcgcggtcatggccctggaacggatcccggcagatatacgggccgccggcggcgtttcccgcatgagcgatccgggaatgatacgcggcattcaggaagccgtaaccatacctgtcatggccaaatgccgcatcggtcatttcatggaagcccgtattttggaggccattgaaatcgattatatcgacgaaagcgaagtcctttcccccgcagatgatgtatatcacattgataaaacagacttccgggttccttttgtctgcggcgcaagggatttgggcgaggcgctccggcgcatcgcggaaggcgcctccatgatccggactaagggcgaacccggcaccggcgacatcgtacaggcggtgcgtcacatgcggaaaatgaacagtgaaatcgccaggattgcatccctccgtccggacgaattgtttgaggccgccaaagagcttcaggttcctgtatcccttctccgttatgtccatgaacataaaagactgcctgtcgtcaactttgcggccggaggcatcgccacaccggcggacgcggcgcttatgatgcagcttggcgcagagggtgtttttgtgggatccggcattttcaaatccggaaatccggcaaaacgtgccgccgccattgtaaaagccgttaccaattatcaggatccagcgcttctcgccagcctctcggagaatctgggggaagccatggtaggcatcaatgaatcggaaatcgcccttttgatggcggaaaggggaaaatagacgccactgaccggctctatggaaatctactatgagaattggtatccttgcccttcagggggcatttgcagaacataaaataatgctggagggtctgggcgcagaatgctttgagatccggcagctgaaggatttatataccgggccggttaacggcctcgtcttaccgggcggcgaaagcaccgtcatggataagctgctccgggaatccggtttgttttcccctctccggggaatgctggaaaaaggaatcccggttcttgccacctgtgccggtctgattcttctggcagaaaagaaggaggacggcacgccgccctgctttggcacccttcccgtaaccgtccgcaggaatgcctacgggcggcagctgggaagctttcaggaaaccgctctttttgaaggaatcggggattttcccatgacatttatccgcgctcctctgattgtttcggccgccgggcaggtaaaggtattggcagtcacccgccgttatgaaatgacgcagggcatatcccatgaatttcccgctgccgtacgctggcaaaatcagctggccatgtcctttcaccctgaattaagcggcgatccgtctgtccatgcttattttctgaatatggttcaaaatgcagcctccctttccgagggaaggcccgcttaaatagaaaagctttttatgaggaggaaactgaaatgagaaatgaaaaagtccaaaaactggtgatgaccggcgtattcgcagcactgtcctatgtggtattcaccttcctgcagatcaaaataacgctgcccggaggggacgccacatccatccacctgggaaacgcggtctgcgttctgggcgctctgatactgggcggactctatggaggtgtcggaggcgcgctcggcatgaccatcggagatatctttgaccccatttatgtgatctatgcgcccaaaacgtttatattgaagctgtgcatcgggctgattaccgggctcatcgcccacaaatgcggcaaaatcacccatatcagcgacaaaaagaaaattttccagtggacgcttttagccgccatcggcggcctggccttcaatatggctgcggacccgctggtaggctatttctataagctggttatactcggaaagcctgcggcagatattacgctcgcatggaatatcgcttccacctccatcaacgcggttttatccaccatcgtttccgttgccgtctacatggctctccgtcccgccctgcagaaggccgggctcttcttccggctcgggactgcctcttcggagaaatgatctgctttgcttcgtaacaaaaggtcataaaaatacagaaaacattgtaaaaaaacagcgacattccgctagccggagtgccgttgtttttgttataataaactggttcggatatctttttccggccggaagcattctgccgggcatgaaagatttccgtaccctattatatataagaaaaggaagcgcattccatgaccgaacaaatgatgccggacaggccctcaaggccattccggattccgaaaaagattgccatgatcaacgatatcgcgggctatggccggtgttccaccaccgtatcccttcccattatcagcgccatgcaggtacaggtgtgccccgtacccacctccattttctccaaccataccggctttcccgtgcattttatgcatgactgcaccgatattctgccggaatacctggaaaaatggcaggagctggaactgaccttcgacggcatctactgcggctttctgggaagtgtgacacagatcggcattgttaaggactttctggcctctcagaccggaaatgccggacattcccggatatctgccgacgggaacaggccgatcgttatcctggatccggtgatgggcgatcacggcagggcttaccgtaccatcactccgcagcattgtgaagaaatgaaagagctgctcaccatggcggatatcatcacccccaacatcacggaggcctgccttctcaccggcgctgcataccgggaatccggatggactgccgaagagctgaaggagcttacggagaagctccactccatggggccggacaaaatcgtgataacaggcatgcaggacggcgatgattttgtgaatttcatttccgtaaaaaagggacctgaagagcttcctgattgcagcaacagctcttgccgcgactgcttcaacggttattgctgcggctgctgccgtatgcacatcgccggggaatcccgtccggggacaggggatatctttgcttctgtcatcgcagcggatgctgtcaacggcgttgattttttccaatccgtggaaaaggccgcaggctttgtccgcatatgcacccaggcctcttcggagcttgacattccccggaaacagggcgtctgctttgaaaatttcctgtacatgctcgtctgaccgcggttcttccgcctgccccggcagcggttccttatttaaaaaaaacgtcctgcgtttaacgcagtgaaacaaaatatagaaaagaggtaacaccatgaataaaaaagaagttctggaaatccgcaagcaatatactcatgaaaaatgctccatcacccgcatctgcggctgctatgtggacggagaaaagaatatcaaaacccagctgaaggaagcttttctttccctcccggaagaagaaaccttcaaatattttaacctgttcaaacaaaccctttccggcaccctcggcaagaacctgctgaatctggagttccctctggatgcggaaaatcccggcggcccccaggaattcctcctgaagctgcgtgacagcaaactacaggacgacgcgctgcttgaagaattttaccagaaaatcatcgagaactattatttcccggaaaattattacataatcctcatacatgtggcttacgatattcccggcaagtctctggacggttcggaaatgttcgatgcttccgaggatgtttatgaatacctgctctgcagcctctgcccggtcaagctgtcgaagccgggcctcttttacaacgcggaaaccaacaatattgaaaaccggatccgcgactgggtggtggatcctccggtaaagggattcctcttcccggccttcaacgacaggaataccgatatccattccatgctctatttttccaaaatggcggaggaattgcagcctgagttcatcgagtccatgttcggctgcttccttcccctcactgccgacagccagaaggaaaccttcaattacctgatttccgatacacttggggatgactgtgattatgaagtggtgaaaaatatccacgaacaccttacggaactggtggaagagacaaaggattccccggatcctctggtattgaccaagccggatgtgaagcgcctgtttgaactgagcggcgttcctgaagaaaagctggaaacctttgatcagacctttgaagcggctgccggcgaaaaagcgtcccttcttgccacaaacattgcaggcggcaaaaaattcaatattgagacgccggatgttgtcatcaaggtcaatcccgataggacggatctgatcgaaacaaggatcatcgacggtaaggaatgcctggtcatcaccgtgaatgaccacattgaggtaaacggcgtaaatgtccgtacaatcgccccttcccatgaagaagaaccggacaccgatgacggcgccggttccacagcttcttatgaagagacagcagcggatgccgcgtcaaacgggccgtcctcatacacggaggaagaagcgattcccgcttccgcccctgctgccgccccggaggacgacggttactcattctcctgattttcatcctctgccatccggtagcccacaccgatttccgtcagtatgaactgaggctccgcaggattcttttccagcttcctgcgtatattcgccatatttacacggaggatgcggttgttatcatccgcataaggcccccatacatgggaaatcagggaatcataggtgataaccctgccggaattcctcgcaagataggatacaattttaaattccacctgggtcagatgtacactctccccgtcaacagtcacaaggcgcttgtcaaaatcaatgacaagcccttttgctttatagggcttatcaaacgcggctcctccgggacggctgccgtggcgcatggccgtgcggattctcgccagcagttcattggatccaaagggcttggtaatgtaatcatccgctcccaaatccagggccatcactttttccttttcctgggttctggcagatatgactataatggggatggaggaataagaacgcacctgccggatcacttccatgccgtcgatatcaggcagccccagatccagtaaaatcagttccggacactgggatgcagtcagggaaatcccgtctctgccgagcgccgtggtgatcgctttatatccctgcgctttgagagttgttgcaataaaatcacagatatttttttcatcctcaataatgagtatcgttacctttgcctgcatgtttgtatttcctccgctattgttcctcatcctcactgcctcttggcagcgtaaatgaaaattgtgctccatgcccatgattgcatgcacggatgcttcctccgtgcgcagttattatcgtcttacagatggagaggccgatccccattcctttatgcccgtccgaactgctgttttccgtctgtccggttccgtcaaaaattgttgccagcttctcctccggaatccccactccctgatccgtcaccagaaaagtcacttcatcccttcctatttctgcccggcattccacaggctccgtgcttcccgcatgaaatatcgcgttttccatcaggttgataagcacctgctctatcagcgtggcatccatgggtatcatcacaaattcttccggcagaagtaccttaatctgcgcatccggaatcctctttttcaagcggtagacagcttccgccatcacctcctccacaggctccagggatttgttgacactggccgaatcgtcacggatccgggtaacagtgaggaggttttccaccatatttaaaagccagttggcatcctctctgatatgtctgaccatggttctcttttcgtccgtattcagcctggcctcattctccagataagaactgctggcgccgataattccggttaagggtgtccgcaggtcatgggacaccgccctgagcagattggcccgcatcttctccttttccgcttccgccagcttcttttcccgatccgcaagaatccgggactgccgcttcatatgagaggccgaggcgctggtcagcaccgataccaccagcatgcatataaatgtcaccggataaccttccagaatgaaattgatctgcccgtaaggatatgtgaaaaggaaatttacacatacaacgcttatcatggctgccgcaattccgggcaggtatccgctggtcagcctggatataaaaagcagcgccagggtatagaacataattacattgatgttgcttgcagatatccggtaatataccagagccactatggtagcggtaagaagaattcccagggtaatcagtacatccttccaggtgaatttatatatttcatccgtaatttcccctttcagcttctgccatcctccgtcttttttcatgcatcgtccctttccgtccgtatcccatattttctcatttccccataattatacgttccgcaataccccctgtcaacgatgaggaatcatccggttccgttatttccgaagccgccgccctgcagcggatcccgcaggcttaaaaagcagaaaaccgggacgtccagtcaatggaccgctcccggtttactgcttttattcatcacttattatcagctctgtaccagaattttttcaatttccaccacatacatgatatggaaatccttttcctcaaagaactggtccaccaggcctttgtccaaaaagctttcctctgtcataggctgttcatagagcttccggcagataagggccatacggctttccttaaataccggcgcgctgttcaccatttccacatgcaggccgcttgcagcgattttatcctcatcccgtccggaaacagttcccatataattcaacatcttacggctgctgtcatcgaaaaagctaagggaaagcttttcattcttatcaatgaattccttggtatatcgctgaggccttacaaaaacaaaagccactcttttcccccacaggataccaagtcctccccagctggctgtcatggcatttaccctgccttcatcctccgccgccaccagcatccagtcctcgttgattaaacggaatacattatcggtcatttcttcgggtttgattttgtcccacatgcttttttcctcctgtctgtctttacctctccggcataatcactgccacgataaagtatgcaataactcccaggaaacctgctcccagaaagatactcgcggctacccatataattctgattatggtcggatcccagttaaaatattctgcgataccggcacatacgccgcaaaccatcctgttggtggccgatcttttcaggcgtcttccggtctgacggccgctgtcgctgtaaccgccgtagcttccattgccataaccgccgccatagctgttgccgtaaccgctgttttcctggcccgcaccgccgtagctgttgttgaaaccgccattctgccagtcatttccctgataagttccattattgttattggagttataattccctccattattatactgtccggaattctgtgtattatcactctgtgattcctgggtattattttcattgttcatatattcgtccatcttatcctcgctttctgcctttacaaggccagcacctatttttattatcggctattcgccctaatttgtaaagtaaatttctatacttcccatggaacatgttaaatcaaaatcgctgtccgcatcataattcatcgtacgttccgacgccatcccggcaaaatcattttcaccgatggacatactgcccattgacgtttccagctgatagttatgatcgctttcttttccgctcagagacatatatacggtacccatgccgcagtccccggtcatatccccggttatggccccgtcgtaatccatgcttcccattccaatactgaaatacatgtcatcaacggtcatctcattgaaatatatctgtcccatgcccaaattaatattggcctcatccgcctttacatccgtaacattcaggcttccggctcccacatcacaattgagcacctccgtattaaaaccggaaagatccgcttcccccgctcccagccccaaatatacattcaagaaagagatatcggaaggcagataaaggtaaacccttgttgcagaatctttgaaattggatttgttccggttatccagcactctgatatacagaatcccgtcttccacataatactgcgccttttttaccttctcaccttccagatggatatctccatccgatgattccgaaacataaaaacctgcgccgcctaaatccagatcaagccctacgatggaatccctctgcgctgcgtaaggaattgttgtattgaaatcttttccctgtatcggataattgctgttaaatcccacgctgtcttcttccgatacattccagttattatagttatatcctgtaaaaggaatgttcagttcattattataatacatttcgtcaacctgatacctgccgcccgccgcttttcctgcgagactgagtaccgcgcccagcagcaccattgccagtgcggccagaagagttatttttaaaaatttattcattttctttcctccatttttatgccgcatttcttctggtaaaaggccatctgcaggctctcacgaatgctgtgcagactaccgggaccactttagccgccacccaaatcataccagccgtcattgcaagaccaattcccgtacatataagtccgccgcccaacaggtaaattgctcctgcagggaaaaggaacagcttggtaaacgcttcaattacaagaaccactccaactgccaggactataaagccggctaccacgagagaagcaactactgcgatgattgccactgcaatactgaaaatcactgccagcactgcaattcctatcgggacgataatcggcagggcaaaaatacataaaagaacaaataatatgatttcaccggccgtacgtctctttttaggaggtctgttataggtatcgtaggaatatccatattgattctggtactgatactgattgggtccctggccctgatactggttataggtattctgatattgattgcggtaaggcccctggttattattcgtataagggcttccctgatatggctggccctgctgataaccctgattgggatttccctggtattggccgcccgggttttcctggtacccggctccccgattgggatttccctgatactggttaccctggctgggatttccctggtactgagtaccctgaccgggatttccctggtattggttggcctgaccgggattcccctgatactggctgccctggccaggatttccctgatactgggtgttctgatactgattctcctggtaacggccgttttgctgccggcctgctgtttcctgtccctgctcccgggaagtatcctgtccctgctcctggaaagcatctgcccgggctcctgaggattcctgctctctgttttccgtctccattgtatcagagacgttattttctgcagttttctcttcatcaaatgcctttgcaaagatatcttctgagaaatcatcacccaactgcaggacaattctgtcactgttattcccggaggcttctgattcttccgcagcttccgcagccgcaggggcttcctcttccatattcatatgatagccgccctcggtgaattctcccgtttcaataccatcccttaagccttctttaatattggcggctacctgtgcgggtgaacccagcgaaccgattgactcttcttcattttctatacctgcgtcatcaaggtaatcattataatattgtaatgcttcttcccgttctgcctgtgaaatgtccgaaaggagcatttccaactgcttcataaattcctgcctgttcattatttaatacctccctcgaacattcccgttatttttgcggaatacttattccattcttcttcgtataacgtaagctgtgccattcctttttccgttaccttgtaatagcggcggttcctgcccgcgcattccatgtcgtaaacagcaaggcagtcatccttttgcaaccgtctcagcaccggatacagcgtggactcggataactcaattacctgccttacttcctgggttattttatatccgtaggtcccttccggttcctttgagacaacagcaagcacaatcgcatccaaaagtgccgctcctgtattaaaaaccatattctgcactcccttctaatggggctttcatactatacattgtataatattgttctttaggtatactatatgatatataatatttttagtcaaggaataatcagggaagaatcgttgaaaaatagtggataaaaagcgaaagaaattcttaagaaagctccgactaaagaaaaggagaaccccgccaaaattaaccggcagaagttctccctctttttactgttcctgttttatttcagttctccgaagagaaatattttcttcttaaatttacagataccttaattctccgtaccatcctttaattcactgccctctatggcactgtcaataagctttaacagctccagcgcactgcggaaatgctttgtaacacctttctccgtccaggatatggatccctgccatgtagcgttttgcctgctggtcacacggacaataaaggaagccttgcgtcccacctgattttttatatcctgttcatccttcaccgcttctgcctccttgtctgtttctgtttgtacttttttgggtttcagcgttctgtcacgggtcgatggctgcgggaaattaagcctgtcatataacgcctccatttcagccaatagctgaagctggttggtgaaaagcacaggggtttccgaataacaatggtacatccgtccttctatcagttcctcttttatctcgtcaatgcagacacagatgacatttttcggtaaaaagcccttcttcaatgacgtttgctgcatatagcacctccctctcatcgttaatttgagtataacggacatagcgtaacgtcaagcgttacatttcgcaaaaaaatgttaatatttcaaatattttgttgaatattctgaacaggacagtttctgtcagcgcggctgactgcattatatatagaagaactcccaccagtaaaaccgacaggagttctcttatatctgacagactatggttttgtactcaagaaggagatttattcttcttttttacgcttcttattatatacggtaaatcccagtgtcagcacggcgcccatcatcagcagtgaccagcctgctatcggtgcggtatctccggttccgggtcccttgctttctccaaggacacttacctccggcgcaaatgcttcaccaaggacgcccatttcaggtccttcaggagcaaacgcttccccaaggacacctgctgtggctgcaggcgctgcaccgggagccggcgcatcaggtccgggaccggggacagggccgggatccggtgtgggagtcggtgcaggatcaaccggtgttgttgtgctttcatacaaagctgtaaatgtcatatcctctgcaacctgatattctgcatcaggcaatgcctgagaccagtcggtatgccggtaatctgtatccgctgttactgtgggtactgtaatttcggaccattccgtgcccttcagaaccttccagcttgtttggccatccagacttccgtgtgatcccggaaggaatgttactgttacccatgcatcatcatcttccacatagtaaactttgattactgcgccatcagaaactaccacttttccattaaccgcttccggatcaaccttgctgtatttatagcccgttaacttcttcgcaatctctgtatctgtgggtttctgaatatcacttaacgccacattatttacactgaccttcgctgttttttgctcgcttcccaccaatgtattttccgcataataggaaaccgtataattaaatgtctttaaatcaaagtaatacttaatttcctctgccttttttttgtcattcgaggcaaatgcaataacctttgacttttggttgttgtagacatatcccggatatgcatccttatccgtacatagcttaattgcatttttctcagcaagcgcactgactgtataagatactgtttcatccaatttatagcttccgttttcctgttcaaagtaatacttcacctgtaaattggcataattactgtcttctgcatctgcccacactgccttaaatacaaactcattctgggcattcgcatattttatcgtacctgtactgattgtgaaacgatcatattgcctgtactctttgctggttcctgccagttcccagtgatcaaatacttttccctctttctccggcactctgtttgtaatagcaattacgttattttcgccgctgaatgcagtataggtatctgaatctgtaatattgccggttccgccgttcaaatcatattttacagaataaccggccttttcaatacttaagaatatctgtttatttgtctcggatgaatagcctactttaaatctgtaattgtatgttactccatctctgtaataagtacctttttcaatggaaattccattcatgcctgttccggttaatttaattttgtttccgtcataaccgggtaagatattaaaatagaattcatttccatctttatctgctttgtaaacagtattaattgtgccggttacccatttaccggtataaccctcatatccatagagctgattattcgctataccgactaattgctttataataatttccggacgcttattacttttaaaattaccgctgttaataacgatatcttcatatgcattggtaattgtaatagcataggtatatttattaaaatcaactgtcctgctgccggtattgattttttctgaaacaacattagttaattcgatcttcacctgggtcccgctgggtaaagttgttgtcgcctgcgctccctttgtatagctggtgggaacattgacaaaggttccattaatctgtaattgatttaagagccagtccgtccaggtaccttctccatcctgatggccgctgtcacttaccagtgttaattttaaggtttcaccatttccaaaagaggagccggaattagggcttgtaatatttccctgtcttatttcattgttggaataagttaatttatagctgttaaccttcttaaatgtaactgttacttcctgatcctggtctgccttctgcaccgtataatcccatttatagtcagtaactttcgttccatttattattgtaccatttactttcacattatcgattacataaccacggttaaattccacccggaaagtcagatcactgtccttcttgattttctcagggccggttacgcttccgacgtccgaactcggtgtatcgttaactttcgttatataagttacattcaggttagatgaatctgattcatagaacaaaacaatctctctgccgttttccagtattgttcccgcatcggattcccctacactgtaatatacgatatcttcatatacaccgacatactgaatggtatcctgatctacttttgcttcaacaaaattgtagcctgcaaaagaaggggcattctctttgatttcccctgccggaagaagaaatgatccgtcattatcatccgctccggaaattcttactgtcactgattcctcaggattagcccggagaatatttctcatgagcaaacgctgtgcggcctgctcagtctcaacagaaacagtggtatccccctgaatatttttcaggatataagagccgtccgaagattccagatcagcgccgtcagctgttacactttttaagcgatacccctttccagtctcaacctgaaaggacagatcactgtctttttctgcttccgcactggcaacagcttctccatttactttaataactgcctcaccgctgacatcaaatgaaaccataaaagtatctttcttttcattttctgaagtctcagtaacctcctctgtaacggtctcttccgtttccagttcatcttcggtggatactgcagagatttcgctctctgtctccgtattctccccgccggcttccgtggtttcttccgactggtccgtctccgacgtctgtgttccttccggaacctccgagctttcctcattttccgaagagtctgatgaagctgctgatgtcacttcttctgtcttatcctcgtttgcatccgatgccggttcacttgatatttcggctgctgattctacttctgcggcagtaacagtcatgctgtcatttcccaacgtagtggcagccagaacaaaaaccagcagaaatgcccaaagtctttgtaacgattttgcctttttcattcctctttctcctctcttttctttaaacaacacttaaccaaacccctgttttcctaactgtcatttactgcttcctcttcatcatcttccaaagcactggcgataagcttcaagagctccagagcgcttcgaaaatgctttgtaattcctctctccgtccaggatatggatccctgccatgtggcatactgtctgctggttatccggagaatgaaggaagccttacgtccaacctgattattggtatcctgttcatcccgcacctcttctgcctccttatctgcccctgtttggattatttggttccgtatactgatttccttcaccattaaattgagtataacagccctggtgttacataaagtgttacacatcagaaattagtgtaactattttttaactttttttggataaacaggaattttttataggaaaacacttcttaaaaaattattttccatgtaataccaaaaagaccgcccggatttctccggacgatctttttggctaaggaattattcctcttcttttttacgtttctttgcagtaattcccaatgtcagaatggctcccattataaggaatgaccagccggctatcggtgagctgtctccggttccgggtcccttgctttcaccgagaacccctacttcaggaggcagcgcttctccaaggactcctacttcaggctgtgcaggggcaaatgcttctcccagtactgctgttgccgccgcatcaggtgcgcctcctgcaggctcatccggtattggtgctgccgccggtgtatggctgttggtaatcgtaaagccatcaataacagtactgtaaccaactacatccgcttcgttaaccgaatattcgatctcctttccggcagtattatatttctccaaatcagtaaattcatatgtccacaaattttcagctgttatcgttgcctctgttacagctttatcatctgcgagtaaactgaccaatatactacccggacgaatattatcctggttatctgcatcctcccaaatctttgtaactaaaatattcacaggatcttcttccggattctttccggtatatctgttcaccacttcaaatccattttctgcatccccatcaatatgactttcatagccattaatactgtcttcctcaacctcataaataatgggagtaccattttccataaaccggggaagatccttaaattcaaacgaccatcccgtactttcatcaacgacagcctgatccatttcttccgaatcagccaaaagccttatggtaatactctccggcaattcacctccgtcataatcaagccatgtcttggttccctgtacggtgatctgtgttaaatcagactcaatcactgtattggtaaaaatccgtccgtcctggctgacttcctgttcataaccttccggaatcacttcctccaccgtataggttatttcctttccgtcatccgtataccttttcagcttttcaaagctataactccagacatttccatctttttcccatacaggcgtcacattttcctgctttacaccatccgcatacagattaaggaccaaatcatccggcctggtatttcctgcattgctgtaatctacccagatctttgttccatttaccgtcgtaagcgtctttgcatcatcaatcagcttattaaccagatcattgctttctccggaatctgttcttacatatccatccggtacgctttccattaccgtatatacaatctcttttccttcggatgtatatataggtaaatcagtaaaacgataattccatttatttccgtccgtattgctccagacaggggttttctctacaggtgttccgtccgcgagaagtattaagctgaattcctctgccgatggcctggttccttcgacattactgtaatcttcccaggtcttggttccttcgaccgatttcagagttctctcatcgtcatttaccgtattttcgaaattattatcagccttaccagtctgtgaataatcctggagttttttctcctctaccgtataaactatgagtatcccgtcatccgaatatttcttcagaccggtataactatagctccatacatttccgtcttttgtccaatccggagttatattttccagcttttcaccatccgcatacaggttcaggatcaaatcatccggcctgctcttcgttacattgctgtaatcctcccaaacctttgtcccgtttaccgtggtaagcgtccttgaatcatcagtcagcttattgaccagatctctgttgtcccgggaatcggttcttacatatccatccggtatggtttctgttaccgtatatttgatctcctgtccatcggatgtatatatcggcagattatcataacggtaattccatttattcccgttagtattgctccagacaggcgctttgtcaacgggcgaaccatctgcaagaaggattaaattaaattcttttgccgttggcctggttttttccgcattgctgtaatcttcccatgtcttggttccttctactgatgtccgggttctctcatcatcctttacggtgtttacgaagttattcccatcttttacagtctgtgaataatccggaagcttttcctccactacggaatagtttatgagcaccccttcatccgtatatttctgcagatcattgtagctatagctccacacattcccgtccgtattgctccagacaggtacggcgtcagtcaattcctttccatccgcaaacaaatgcagagtcagtgtctgaggtcttgttcctccggcattgctgtaatccacccaggtcttggttccgctaagtccggtcgtccccgtaagtgtatttatcacatcataattttctgttcttgaacgatatccctctgcttctgcttctttaattttatattcaatttccgcgccgtctttatttttaggcagtcctgaaaacgtccatgaccatccatctgcggcagttacttctttagaataaacattcccatcggagccctgaagaataattgtgatgctttccggcctggtgccatatgcattatcattatctaaccaggttttcctgccttcaattgtaatttcatcaggtgtatgagtattggtcagtatgaaaccgtcattcccaaaagcatattttgtggtatatccttcaacgtcttcctctttcaccgaatattcaatacgttttccattttcatactccggcagatcaggaaaatgtccgttccaattgttacctgaattaagcgttattgtttttgccggaatatagggatttccattcttaagcagctccactgttacactttcaggcctgattccatcctgattatctgcatccgcccatttcttggcaacaggaatcgtaatattcccttttccgactaacgtattagtaataatatttccatcctgggaactttcgtaattctccggtacattcgtttcttttactgtataggagatttcctttcccgatgtatcatacttgtttacatctttaaaagtatacatccagtcattatctttggttaatacagcgttattattggtagccttgccattagctgttaagtttacggtaatactatccggccggaggcctgccgcattatcatcatcaacccatagcttggtcacctctacatttacaggagcctcaccgggatttttccccgtataggtatttgtgatattaaatttattcttctcatctacagtggatacatatccgtcaggcactatttcctctaccgtatatatatactggcctccgccaggcctgtattgaggcagcttttcaaagctataagatgttcctccgtttgttatctccgcagtccggtatggcgttccatcccgatacaggttgatcgtaaccgtgggataatctgttgttcccttcggcacattccaggtcttcctgccgtttatatcaattcttttcaaatcaaaataataattgatatctattttatcgttattattcgatgcaaaaccaataacattggattgttcttcgttatatatatagtcaggatatctgtccttatctatacacagtttaattgccgccttttctgcaagcgcgcttactgaataagaataatctacctcataatcaccatcttctttttcaagaaggtaatttatctttacattggcatagctgctttttcctatatctgcccagacagctttgaatacaaactcattcttattatttgcatatcttaccgtagaagcatttattgtaaaacgagaatactgcctgtaaacaccactgttatcacctgctaattcccaatgatcaaatatcttcccgtccagtgtcggcactttatacgttacagcgacaatattattttcaccttcaaatgctgtgtaagtatcatcatctgcaatttcaccggttccgccgtttaaatcatacctaaccgtatattttgctttctctgtactcaaaaatatctgtttatttgtttctgatgaccagtttaccttaaacatatacttatacgttttattatctttcgtataagaaccttctttaatctcaatcccgtccatgccggttccgcttaattttatatcttttccgtcatatcccggcttaacattaaagtaaaactcatttccgccgctgttggcagccttataaacatcatttatagtaccgtttttaaacaggtttccattggcatccaggccataaagccggtcaccctctattccctctaactgcttgataatgatttccggtcttttattgcttttaaaattaccgctgcttatatctatatcttcatacacatcgctgattgtaattgtataggtatatttattaaaattttgacttctcccgttgccggtactaattctttccgaatcaatttgggtcagttttacattcaccttggtaccgctgggtaaaattgttgttgcttctgcgttcgtctcatacgaagaaggcacattaataaatacgccattgacctgcaggttattcaagagccaatccgtccaggttccttcaccatcctgatgcccgctgtcgcttaccaacgtcaggactaatggcttttcaccggtaaaagttgaattatttcccggagatgtaatattaccctgcattattttactattattataagtcagcttataactatttattttcttaaacgttactataacattctgcgttttcgtaacattctgtatcgtataatcccatttattatcagcgactttggttcctgttaatgacataccgccatttattttcacattgtcaatctcataaccacggttaacttcaacccggaaagtcagcgcactgttccttttcacactcaccgggcccgttactgttccgccggccgcgctctgtgcatttcccacctgggttgtataagtcacttctaccttcagcgaatccgattcatagtacaatacaatctctttattatcctctaaaatcgttcccgcatccgtttctcccgcactgtaataaacataattctcataaacccctgcaaactgaattacatcatcatctacccttgcttcaacaaaagaatatccgtcaaaagcaggagcatgctctttaatttcccctaccggaatattgactgtccgatcattcccatccgctccggatactcttactttcacggtttcatctgtgtttgcaagaaggatatcacgcataagcatgcgcagcttattccgctcggtactgacagaaactgtcatatcatcctgaacattttccagctgatacgtacctgctgaagtacccagctcactgccatccgccgttactttctttatccggtaaccatcggaagcctccacataaaattctacatttgtaccggcttcgatatcttctacgagagaaacactttctccattcactttgacaacagccccgtcaccaacctcaaaggaaaccgtaaaggaatctttttcctcctcttcagaagtcacttccgttgaagtctcagtaactgtctctgtttcaatctcttctgtttctgtcccctcttcggaagttacagcggcgggttcactctctgtcccgctttttgtactttcctcattatcttcggaggctgtttccggctcatccgcctttccctcttcagatttctgcgttccttccgggacttctgccttttcatcactgtctgatgaagctgcagaggtctcttccactgtctttttttcatttgcatcggatgccgatgcactcgacacttcggtcgctgattctacttccgcagcattaacagtcacgctgtcatttcctaacgtagtagcaaccagaacaaaaaccagcaaaaatgcccagaatctttgtaatgactttgcccttttcattccactttcccctctcttttttacaatgcttgctaaaattaaaattgtcctcaccatctttttctgcttcaccatctgacctgcggacaatgaatgaagctttacgcctgctctgtaagtttatattccgttcttcccgctcttttctgcctccttgtcttctcatatctgcatattgggtttcagcctactgttacgggagaacctctgcggaaacatgaatccggcctgttaatatcgaattcataaatcaaatttcccccattaataactcaagtataatgatcagggtgttacatcaagtgttacaaacctaaattaaggatactattttccctttttaagtaaaatttatagatgacagcagattccccctccgccttcgcatatatcaaacgccaatcccgtaatggtgataagccgtttgacacatgcaaagattagactgctaaaaatgcgcaaataaaaagaccgcccggatttctccgaacggcctttttatgtatggacttatttctcttcttttttacgtttctttgctgtaattcccaatgtcagaatggctcccattataaggaatgaccatccggctatcggtgcggtatctccggttccgggtcccttgctttcgccgagaactcctacttcaggaggtaacgcttctccgaggactcctacttcaggctgtacaggggctaatgcttctcccagtacggctgttgttgctgtaggtgtgccaggtgtcgggtcggatgtcggtccggggccgggttcagggtcggggccaggtgtaacagtatctactgcaaagtgtgcggtataagttgctgccacatttaagccattcacttttgcaggtacgtaagttgcatctgtacttactatatcaccattattattggtccagtttacaaaatgataacctgttactgccgtagccgtagagccctgtgcttctcccttcactgccagcaatgtttcatcagctctgctgacacttccacttccatcagctacataattaatagtgatttcattttcagtatatattaccttgagcacatcaccattttctactttttcaggaatatcctctgatggtatcagagacttcagcatatccaaaactcttcgttctgccttcaccaattccactctgtcatagctgtatccgggatattctttctgctcaatgtcctctacatccaaggtatccggatcgtttacccaaacatccttacttacctcatatgtatctctcgcatctgtttctccttctacccaatactccactccataggaaatagtctttgttatagtcatgtcttcctcaaagtgtgctgtataggtatcagctacattcagattatctaccttctcgggtatgaaatgaagttcttcacttacaatatctcccttgctgttagtccaatttgtcagtttataaccatagtccggtttagctgtggaaccttctgcaatacctgtagcaggtgcaaggctttcgttgtcaggatccacgatgccatttccatcagcaagataaataattgaaattttttcattttcctcaaagtttgcataataggttgccgctacattcagtccgcctaccttgacaggtgtgaaggatacatctgtacctaacacattatcatccgcatctgtccagtttttaaaggtatatccggctgctgctgtcgctgtcgaacctccagcaattcccgttgccggtgcaattgtctcgtctgtaggatttacgtctcctccaatacgtgctacataattgattgttacttctgcattctctacgaagttcgcataataggtcgctgctacattcagtccgtctaccttagctggtacaaaggttgcatctgtacttacttcctttttattctcatctgtccagtttacaaaggtatatccgggtgccgctgtcgctgtggaacctgttgctgtacctgttacagggcgaagagtttctgatcccttatctacgcttcctccggtacgcgccacataattaattgttacttctttattctcttcgaagttagcataatacgttgccgctacattcagtccgtttaccttcgctggtacaaagactggatctgtacttatttcattattatactgatccgtccagtttttaaaggtatatccggcgcctgctgtcgctgtcgatccttctgccacacctgatgcaggagggagaatttcttcatctttgtttacacttcctccgatacgcgccacataattaattgttattgattcgttctctttgaagtttgcataataggttgccgccacattcagtccgtctaccttagctggtacaaaggttgcatttgtacttacttccttctcattctcatcagtccagtttacaaaggtatatccggcagcggctgtcgccgtagaacctgttgctgtatctgttgcagggagaagattttctgatctcttgtctacacttcctccggtacgcgcttcataattaattgttactgcttcattctcatcaaaatttgcataataggttgcaccttcataagctccatccacttttccaggtataaattcaggtgctgtccctacttcattgccctttgaatcggtccagctcacaaacctatatccaggtgatgccgttgccttcgaaccttctgcagttccggttgcaggagacagtgtctcacttcccttgcttaccacaccgccttcattggcaatataattgattgttatcttatcattttcctcaaaatatgctgtataagtatctgctacatttaaaccgtttacttttttaggaacaaattcggcttccgaactaactacagtacctcctgcgtttttccagtttacaaaatgataacccttcgctgcctcagctgtggaacctgccgccttaccgctaactgtttttattgtttcaccgctattggtaacacttccattatcatcagccatataattgattgtgacactattttctgtataaaacaccttcagtacatcaccatttcccactgtttcaggtaaatcttttgaaggtatcagtgcctttaacctatcaaacaggcctttgcttgctcttacatgttccactttactataactgtatccgggatattccttttgttcaatgtcctccacattcagagtatcatcatcataaacccatacgtcctggcttaccttatacgaatctctggctgtgctttctccctcaagccaatactctacactataggatattgtcttagttatagttgtatcttttacaaaatgcgcggtataggtttccgcaacattcaggccattaactttccccggaatgaattggagttctttacctacctcttctcctttgctgttggtccagttttccagcttataaccatagttcggtgttgcaagagaccccttggctactcctgttgcaggtgccaggtcttcacttctaggttctactgttccttttccatcagcaacataggtaatagtaatatctgcattttgcttgaagtgtgcctcataagttgccgcaacatttaatccgtctactttttcaggagtaaatgatgcatctgtacctactgtatcacccttttcatttgtccatttttcaaaggtatatccattggcagctgtggctgttgagccttgtgctgttccgttgacaggagctattgtttctgacccgagcgatacacttccgcctgtatgagcaacataattgattgttatatcatcattttctacgaagtttgctgtataagttgcaggaacattaaccccatttaccttttgaggtacaaaattaagcgtggtacttacagtattgccatctttatctgtccattttacaaaatgatatcctgcagaggccgttgccaaagatccctgcgcaattccggttgcaggccgtaaggattcaaatgtctgagatacgcttccgcctgcagttgcctgataattaatagtaatattttcattttctgcaaaaactgcataatatgtcgcggctacgttaaccccatctaccttttgaggtacaaaattcaattgggtacttacagtattgccaccttcatctatccatttttcaaaatgatatccagcaaaggccgttgccaaagatccctgtgcggtttcggtaacaggcagtaaagtttcatatggccgtgagacacttccgccagtctttgcttcataattaattgtaactttttcattttccacataatatacttcaatcagtttattattagaggttatttttgtaggaagttcaggtactattttatcctcatgataaccattcggacatttatcaatgacagaagttatttccattccattgacaactgtgtcactttctgtccaggcagactggaatatatcgcctaaatagtagtgaacctgataagttattttctgcttttcataatagaacttgaatacattttgggaagagtccttggacaaggaaacatacatattttcgtcctgcccgtcagccaatacatatccctcagactgtaaatcgggtgctgtaatcattatggcagcactcattgtcttgtctgttgttttctttaattcttctccgctctctttttcaatggcaattatcgtatattcacgaggtgacggtttggaataatagaaaacaatttcattgcctgtctgtgccaaatcaagctgtttcattgcttcatcaggaacaaactcttcaatatcaactgcccattcggttaccttcttacctactctgatattctctcttgtcacagaagggcttaattcctcaccggtatcctgatttagatattttactgtataagaagtatacagtttaggactccaatgagcatataatgtaaatccttttgtaaccggagttccaaaatcatactttgctccgccatcttttgcagtataccagccctggaaatcatatccttctctttccggagatgcaggctgcccaactttttccttatatggcacattcactctttgagctgtcggtgcatttgaataattctgatcaaaaatcacatcatacttattaatttcccaaccggcatatacggtgatgttatgtgccggcattttatcacgtccgaaattgacttcagactgtccgctcgtatcataataccaacctgtaaaccgatacccttcacgggtgggaactgttcccggtctggtgaatgttgcttcatatttcactttttgagaaccaggattgcctgatgcatctgttgcatttaaattataagtaacattgtaactattgcggctataataaagggttttggagctcgtactcatatgatcatatgtaaagccctctatttcaataatatcaccttcattaattgaccagccactgggcatggtacctctcatgtattccgaatacccggagccattcaagttctccgttttataatatatggtaaccatgggtggcctactaccatatcttttgatattttccgcaggcatggttttcatcgcacccacaccagtatttaaaccactgctggtataccacatatactggctatgggcagcgtctccccactgtgatgatacatcttcaccatactttgctgttatagtcagattattctgtataacccagttatctctgctattctttaaatagaatgttacgttaaatgattttctattaaatttaacatttacaactgtgcttccatccaattcgataactttaccagtttccatcacaggtgtatcaaatccttttgcttctaaccctatttccgtaaattttgaattatctacattgggtttttgggtaacctgtgtccccacaacaccattagctgttgtactgtataagaaatcataccccgtaccatcaacattctcaacccaataaacgatagaataatttgccttctgattaggtttcagcgcccattttgcagttaactcaaccgggccttctaccgtcagattcgttacaggcttattatcaagataccaaccttcaaaattgtaaccatttttagcaggaacgattgttgaaagatcaataactgagccaaacggtttttccagagctgtaatatagtttcctccaacggaatcaaaccgaacggtataaataattctgctatatacgatttcaataactgtattattaccaactaaagtattatctacgattccggcttcaaatccctgacgcttctgagctgctgcttctgtctgagatccaaacattccctgttttgtttcacgctcttctgaataggtaccatccagattttcgaacttatggacaacagtatactgtacctgtgtaggagaataagtaactactattactgtatcttccttcggcatctgtccttctactacagtctggcttgctgtgtaaccggtaattgcaggcgaagtctttctgtatgtgctgccttccttaacatcaatgtagtatgtacttgcagcggtacgtccggctatttctccagcatcctcagcatactgatacttaattgtcaatgtatgcataggtttttcagaagaagcatctactaccataatatcatggcttgctgtcttatttccatttatggtaacagaaatcgttgcgaagccttcacttacaccagtaacgacaccattttcatcaaccgtagcaatcttttcattatcagaagaccaagttgtttctgtaacttctccgttttcaggagtaatcaccgctcttaatgtaatggtctttcccatattaacgatatcagcaccttctatttttacgctttcaacagatacagaaggagcattaacttttacatccacggaatctgtaaaatcaccgtctactgttttcacagtgattgttgtattccctgctgccaaagcatcaacattgccatcttcatcaacagttgcaacctcttcatttgaagaactccagattacagattgaatagttgcgttttcaggactgatagtatatttaaaggtatatgaatcaccaactgtcaattcgccaatttcaggatttgtaattgatattccggtaacttccactggtttatttttaatttggatttcttttgtattagatacagttttttctcttttaccaaatactgttgaatatgtatatttaatactaacttgtactttcaccgttccggcagttcttgcatgaagtattccagtatcgctgtcgattgtcgcactttcacttccgctcaaaatttgccaagcttcggaacctgaaactacatccttttcgtctatattcgttctactatatgtaagagttaaatcagtaccggtataaacatctccctctaccggattaatcgttactgctccattacgcgtagatgcatataatgcaacattggctgctgccggctctgcaataatatctacagtaacattctcttcaatattacttaatgtatatacaccatctgtttctgtaagggcattgccgtccgccttaacttccttaatgcgatatcccttagactcatcagcttctactgaaaactgtaagtcttttcctttttccacttcagcattggtaacggcttctccgtctaccttgactgtagcttctccggatatattgaagttgactgcataagtcactttattgttttctgtgatttcctccgtatctgtcacggactcttccgtttccagcttatcttcgtcagatacagtagtggtttcactctcagtctctgtactttctatgctggtatctgtagaactttctatgctggtatctgtagaatcttctgacggatccacagttccctcgtcagtagtctgcattccttccgggacttccgacttttcctcattttccaaagaatctgatgaaggtgcaggtgtctcttctcctgtcttatcctcaattgtgtttgattccggttcacccgcttcttccgttaccgattgtacttccgcggcattaacagtcatactgtcatgtcccaacgtagtggcaaccagaacaaaaacaagcaagaacgcccaaaatctttgtaatgactttgcctttttcattcttctttctcctctctttttaaacaactcttaactaaaacccctgaatttcctaactgcttttaccttcttcttcatccaaagcgctgtcgataagctttattaattccaaggcgctccggaaatgctttgtaactcccctctccgtccaggatatggagccctgccatgtggcattctgtctgctggttacccggacaataaaggaagctttgtgtcctaccagatttttactgtcctgctcatcccgcactgcttcgcctccttgtctgctcctgtttgaaaaattgtttcagtatactgtcccgggttactgcatgaggaaatttaaaattattaacggatacgtctaactttataattcatatctccctcatcattaacttgagtataactatcaccacgtaacaccaaccgttacattttttgaaataatgttacaatttcaaattttttttattgcacaaaaaaagacagaacaaacgcccggattattccaggcgttcattctgtctcaatatttcttattatttattttatttccatatcagtcccaaagggaattcgtcttggtaaaagttatattctctttcggcaggctgtcttcagcagccggctgcaccttgtattctatggctgcgcgggccttcaggccaaagctgaggaagcgtccgtcaatcctgtgctgaatgatcacacagtcttccaaacgaagtccattcagcagcatcaggtactgattcattccataacgtgtataaaaatcacccttcctcagggaagttcctatggcaagtttcagcttttccatatatttttcaagctttacctcatctgtaagggggcgcccttcccgatctaccatggtacacagcataagataggcggactgcccgttacgttccagcattcggcatactatatgatagcagtcggtaaaaccgggataggtgcagaaataagctccggactggaatttttcttcctgaagcccctgtttgatatcagtcataaccaccgcatgatactgaaccttgtcgctcatggcatggaatctttccaccatttcctccgacggagtaaggcccagttcttcaaaatagaaggtggttgctttttcatacacttccattgcttccttgaaacgtcccaatgacatgagacagtcaatctgaagaagataaaactcctcatagggataataacggcaggcctgctcactcaattccagaagttcctcatgcctgtcctgcttcagcagaatgatctccgcttccttcaggcattcaaaatattttttctggtaatccgcgcaggctatcgccacccattcctccccgccaagctccggcaggaaatccccctgatatacacggcaggccttcattagataagaaagtttagtttcctcatccttttccatttctgcctgctcatatgcatttacaaaaacttccgtatccagttctaccggcacctcattccgatcccagaaataattgcccagcttaatccggatacaatctgcatctttgaaagcttctgtttttttaagatatttgcgcaggcgatgagcattaacccgcaaagtcactgccggatcctccagcacatcattcccatacagcctgtctatcagctgctttctgggaatacctgcattcccggcagccaacacactgatcaaaagctggatcatcttcgtcgtattagcatattccaacggaatcggttccttcccctgggaaagactaaaaccacctaacatattcacattaataatttttttgtcttccattatccctcttcatttctatttttaagctgcgtgagcataatagttacatccatcataagtttagtataaaaatattatccttttttgtcaacgaaaagcaccatgataaaaataatattcttttttaacgaatcctgaaccatctgatttcatgaacgttttctgaaataaaacataaaaactcttttctgcgctccggtcaggcattttactgctgacttttatggtcaacggcagtataataaaaaataacgattgtacataaggagggttttatgaaatttgacaccatacatcacgtggcattgatatgttctgattataaagcttcccggcacttctacgtggatttgctgggttttgaaatcatcagggaaaattaccgggaaaaccggggagattataagcttgatttgaagctgggggattgtgaactggagctttttgccatcccgggcagcccggcacgccccagctatcctgaagcctgcggtttaaggcatctggccttccgggtcgactgcatcgaagatacgatccgggagctgcaggagcttggaatcgaaacggaacctgtgcgaattgacgagttcactcagaaaaagatgacttttttcaaggatccggacgggcttcctctggaactgcatgaataagggaatggcggggctatgccaacgccccgccatggaattcacattcatagaccttttggtttctgtaatagatctcttcccttccctgaaaccactgcatgtttccctgctgtgaacagtggtaaacatattcctctttccggtagagctccggcccgcggaagggggcttctttttgcacatgggaaagagcctcttttaagaaccgggagttaaagccgtccgccagaatacgtccggcataattcattgaccagatcggtattcttttatcctgctgcttttcccagaccgcttcttctcctgaaaaggctgtaccgcccagataggtatccagatatagaaaatcttcatcttcataaatgaaatcatgggcaaggggacggcagggctgtttttcttccgtaccgtttcctgcatagctgttctttttagcgctgagaagaaattctgccagcttttgagaggacaacggaaaagcagggagcgttcctgcagtctccgtacattcatttccatatatcagggcatccactgttactccaaaaatatcagcaagcaatgtaagattaaggatatccggatagtttgctcccttttcccattttgccacggcctggcgggaaacctgaagattttcagcaagatcctcctgggaaagattccgggctttacggtatttttgcaggttgaaaggaaaacggattgcggtcatggcagcctcctgtatggtgtttttcttactattatacccgcacttttttccatatgccaccaacagaggcttgtcagactgacaaccacaggttccgtgccggtccgcattttcttctgctccgttttcttctaatttctatcgaaggttattttactgatgaggtgtcttgctttatccgcgtccttcttttttaccagtacttcatattctttggagtaatccggttttatgccaaaacttcctgtcactgcccgggacgctcccaggcctgtgccgccggaaaggtcacggactttcgtcgtataccagatatgattggaggccaggacgtccctcaccctggtaaagtttgacagggaaaaacccgaaaaaatacgctccttaaacaatcccatccatatcacccttcttccactatcagcagattccatggctgaacctgcagtctttcccccttatccacttccctgccggaaaacaattcgcgtcctttatggccgctgccgcattcctgaagttccctggaataattcaggtaataagtaacacggtttccactgctgttcctgccttctcttataatcaggggaaaatgaatttcctgtttccaggtccaccagcctttttcctgccatatttccgtgagcagagctttcagataggcagacgaggtcatacagcccatataaatacagaggcctttgccgaattcttttctggtgaccgccgcataggctttccatgcgtaatgattatatcctgaaatcacctgagcatccccattttccagaagctccataaacagccgggcctttctctcttcttccggaatttggtatgaatcccccgtcaatcccacattgacaggcactgtgaactggttataggtaataccgaagcattccttcagcagatgaggctggacatccgaccaaacctttacatgttcatcggtaaaagctgttttaaaggtggccagtacacagccaccccgggctgcataatccttaatccgctgcaggcattcttccggggcggagtaaagggctggcacaaacagcatatcgtaccgatccagctccttttcatctgtactcacaaaatcacattcgatgttcatttcatacagagcatcataaatccatcttaccacatcattatagttgacagtattcccgccgtctgccgggaaggggaaccatttcagggctgaaagggcttcattgcttaccatgatggctgttttattctcttttttcagatgaaccaggctggggctgagttcacggaactgccggccaatgcagtaggcttcacgataaaccgcattttcttccaggtcatgactgagaaggcctttccagtatgtttcgcaggcattgtgaatggaatgccagtgccagtacataacggaatccgcaccgctggccagatggctgaaggcctgcagccgcagctggccttcatagggcgtccattcgggaaagccctgggcttctgtttctatcagcaaatagttatcttttttcagggaacggattaggtcgccgccgaaagcgatttccttgcctgtcaacaaatcctgtgtggggtggtaaatgtcacagccggctatggttaccgcttcagctgctttgaaatgatccacatcgggctgtactccatgggaataccctttccattcaaaatcaaaattatgggtgataaactggtcttctcttttatattctcctacgatctctgcctgtcttttcaggaaatccgtaacaagctgtctctggaatttttcaaactcacagccaaggcttccgttaatcgtaccggttacgctggggaattcttcccaggaattgatgcggttgctccagtaagcaaggccgaagtcatgattgaagcgttccaggtttccgtcatattttttccggatgtatctgacaaacatctgctgtacattttcactgctggtaccgaaatgcttggtttcgttatccagctgaaaaccgatgacacagcggtatcccttaaccgcctccatcagtctgcgtatgatccgctccgcgaagaatcgataggcaggatgggtgatatccatgatctgcctggcaccgtaaggccttctgccgcttcgatccgtgaccatgacctccgggtaagcttttgccatccaggccggtatggcgtaggtaggggttcccacaataacgtaaaggccttctttttcacaggcatccagaactttggttacatgggaaaaatcgaaaacgccttcctccggttcttccgtactccatgtggattccgcgatcctgattacgttgatcccggcctttttcatcatactgatgtctttgtccagcctttcataaggcatgtattcatcataatatgctgctccgtatagcaattgatccatggctcatcctcctgttttatctgatagttctatcatataaaggttcggtgggatccgcaagacggatttatgtggacaggtgtccatgttttttattacgggaaatttcaatgggttatttttcacatgcatatgcagactgtaatgtaaataactcaaatggtcacgcagtacgtgaccatttgaaaatttataataacaatgcagccctaaataattctttagcctgtaaagtctattgacggtgaatatgagcaggattttcgttgttcaaaatcgtattcatataaaatacatttaccaaaaccctttgaattttgtcctaagaaaaacataaatgcattgggagcagaagcaaaaatatgtagtactgcctgccgctctttaatagttctttgcgatatggcattataaactgcattggcaagaattgctgcatgatttccatctactattgaaaaatttgtagtaccgccttcacttggagtacaattaataatacgcccaattgtcagattgttctctttaaaaaaatcaatcacatctttgtgaatattacgagtaacatttaggattaatgcagtgtcatattgattttcactaaatgtttcatataatatatcccaattgcaataattccttttagatgatagttttacatcccacaattcaatccccttcgttgctgttttttgcattggaaagatgttgatccccattttactattgaatattcttcctgctgcaaaagctatggatgtatgggtatctaaatatatttgataggcctgctttttacttgtagcctcgaataaaaatccttttagtttttcataaacatcattattccaattatattcatccttaattttgcggccatcaaacaagtcagttaatgacaaacaactttctgtcttttcctctatgtctcctccttcacagataaagctttttactccaatagatattctttcaggcgtatagctattagcgacaagagtaatgcgtttttgcagctcttcatcaaattcttttctatcaatacccttaccatgtgttgacgaaatcatttgatcatttacggttgccgatgcaataaggtcaatctggtcaaatgtcattacatttttgctgtacgaaacatagcgaagcaaagatgcgacaacaatcgtatgcaatatatttacatcatatggaagacgtgaaaacgatatttctttatctttaataatatttatatcaaaccctattaatgcttttttcgctttagcatctaattctccctggtaaaatttgtctatagaattaataaatgtaattgcattatcatcacactgaccaattaaaaaaagttcaaatttggccgagcctacatcgtcacgaataagatctcttagccatgtttgtattgaacttttgctaaaagtattaattgttgatttcacctgaatacttttaataattctgccattttcttctaatgcaatatcaactttatcatcattcgactttaattctatataaattttatcccaatttttctgacacaacgcttcaagaacggaagcaaatgcctgatataaaaaacctcttgatgcttcttttcctcccaaaattccaacctctttcatctttatatggaatagtacatcttcttctgcgcttagcaagagctttatgaactggctcaacatggccttttgatgtactctttcctacagattgtgaaatatacttcttatatatttggctatggccatttcttttctcaacatatattctatatttcaatccatattttcatctgtctttccatctaatattatattgtatataagttcgatatatcatttgatatccatattccaatccacgaggctatgtaagcctcgaccgtcattgcggtagcgttctactgctggaagtcatttcaatccacgaggctacgtaagcctcgactacgcgtaatctggattgttttgtaagtatcattatttcaatccacgaggctgcataggcttcgactttcgaaatgtccatatccagaatatgcaatatatttctatccacgaagccgcataggcttcgaccttgattttgaacatttaatacatatgtatgataatttcaatccacgaaactgcatagacttcgacgcgagagacgagctcattaaagcagggttgatcatttcaatccacgaggctacgtaagcctcgacgcgtatgaaccgggctattgtcatcagccttgggctatttcaatccacgaggctacataagcctctacccttctatgtatcgttcttccatacttgctacaatttcaatccacgaggctacataagcctcgacactcatgcatcacgtaatgatcactgggatgtgcacatttcaatccacgaggctacataagcctcgacatcaagagtttttagatcaggaagatatagataaatttcaatccacgaggctacataagcctcgacaattcgtttcatccacatccatggcatccagttgatttcaatccacgaggctacgtaaacctcgacattaaggccgccgctggcaatgtgtccccaagcaatttcaatccacaaggctacgtaagcctcgacaaactttcctgccgaatgggccagagtgaccgagatttcaatccacgaggctacgtaagcctcgacttgcggcattttctttatgcccggtagcagaggatttcaatccacgaggctacgtaagcttcgacgatttcatgcggagcatgttttatttataatcgacatttcaatccacgaggctacgtaagcttcgacataccgtactatcatcaatggcctttatcatactttatttcaatccacgaggctacgtaagcttcgaccccacaaggcttgtctggtcgtgctccgtcaaagtatttcaatccacgaggctacgtaagcctcgactatacccctacttatcttgtttaatgtttttaaatttcaatccacgaggctacgtaagcctcgacgcagattgcaatgctggaggtgatataggacaggcatttcaatccacgaggctacgtaagcctcgacagcaaaaacattcaaaataacataaccatttaaccccgaaatataactcttacacaaatatatctttacacatttatataataagccttcaaaacatttatgtccataatatttaagcacttttttggtgcgaatcccccggtattttcatgtgcactatacattcgcaccttacttatgaccctcttaaaattataaactccactcttattttatcatctaaaaacaaatatcactaattcttttttactcaatataacgtttatttaataaaataagtccatacagcatttttaatccctaaaatcattaaaaaagctctcatacaactctttcatatgctcatccattattttttcagccgcttcatcatccttcctctcaaaagcgtccacaatctgtccatgataatacaaaccggcccggtttcctctcgcctgtaccactttttcaaaggaactcttcatcacttcattcataatatcataaatccgcatgataatagaattgccggctatccgggccattttgatatgaaacaggtaatcgaagcgcgcaaactcgggaagataatcctttgtcgcttccatcttttgaaataaggactctaattctttcacgtcttcttcagaggcactgcggcaggcttctccgcagaccgggccttctatcattctgcgcagctgaaggatttcttccataccattatcattgagatatgccgcaggtattaaagggctcattacggaagcggcatccgggctcctcacaaaggagccctctccgaatcgtgtttccagcaattccaaagcagataatttctgcagggcattgcgcaccgttacccggctgacgccgaactgccgggccagttcattttcagatggaatcttttcaccgggcttccactctccctccagaatctgctccttcatctgtacaaaaacctgatcacttatgctgtccctgcttattttctgaattgccatgtattcctctttcttccgtctcttctacagaatttccgttttctttaaaatacgccggatatgctctttttcttcctcacttgctttagggaagggtttggaagaacaggcgcagtctataatttccttcatagccattgcttcttttatataaggaataaacggtgtgcccacctgatatatttccatgagccggtcaattttcttttgaagaacgctgacctgttccagatcctcacgggcgaatgcctccgtccaggaatggcataatccgggaaccagattggacagacccgcgatgcagccgtctccgccggccatgatattatgggcaaaattatcatcgaaaccggaatatatttcaaattccgggaattctccttttaccagcttgatcagttccctggtatgatccatgccggcctgggtatccttatagccgactatattttcatattttctcaccaggcgcagcgtaatttccggcgtgaggtcatagccggtgcgatccggaaaattatagaggtaaatgggctgatcggaaagggcttccgccagcattccaaagtagttttccaggcttttttctccaagcgggaaatagtaagggggcagaataatcacggcatccgccccttcctgctttgcaaaacgggaaagctcgatgatttcatcaactatcatactggtggttccgacgatcagctgtgttctgtgattaatcttatgtacggcatagcggatcagttcttttttctgagacatggtcagggcaaaaaattctccaatgcttcccatgagcaggattccgtccactccgccctgaatcaggtgttcgtatacctttccgcagccttccatatccggatttccttctttgtccataaccgtaactaccggtgttatatattttgctttcattatgtattcccccatcttccttttattgccggcttaatagcctgcgcctttcattgctgattccgcatgctccgtgtatctttttaatacgcctgtaaaagctctttttttcagcggcttttccagctttctcttttccaggactgcctggatattgtccgcatccatctccatgccgtcaattcccacaatatctatggtctttttttcgatatcataggaaatcagatcgccggtttccacataggcaataggtcccccgcacgcggcttccggggacacatgaccgattgccgctcctctggtggctcctgaaaatcttccgtcggtaatcagggagacctttccgttcagcgtatggtcacagcagatggcctccgttgtcatgagcatttcaggcattccgctccccctcggcccttcataacggattatcacgacctcgcccggaaggatttttccttccaccacagcgtcatgagcatcctcttcactatcaaaaacaacagcctttcccacatgggaacgcatgcttttttcacaggcggaatatttcaccaccgcaccttcgggcgcaagatttcctttcaaaacagcgatagaacctacctcttccgtagtttccgcaggagtgatcacatcctccggaaccagatggtaattgtgcaggtacccttctccccgctcaaaaaaatgatccttctttatcgcttccagattttctcccaacgtttttccggttactgtcatcacatccagatccagatatttttccagaagcagctgtactttcggaattcctcctgcaaaccagaaggactcggtgagatgctggccgctgggatttatgtttcctatatgaggaatgtatgcattgatttcattaaaaagcccgggatccagttccatgccgagttctgcggcaatggccggcagatggagcagggcattggtggagcctcctatggcgctgtgaatcacaatggcattgcgaaaggcggcaggtgtaaggatttgggacgggcggatattttttgccgcaagctccataattttacgcccggcattcctcgccatggccagaatatcccgcatggtcgcaggcgccagcgcgcttcccggaagggcgagtcccagcgcttccgccatacactgcatggtgctcgctgttcccataaaggtgcatgctccctgggacgggcagcctgtcagtttataatcacggatttcatccggcgtaatttcgttgtttcttttttgtctcagtgatatgtcacccgccaccagagaagtggtctgtcccggcccaggcctcatgctgccgccgggaataaaaatagccggaatatccactctggccgcggctttcaaatgagccggtatggacttatcacaggaggaggaaagaatcattccgtcccacggcacaaaaccggcatgcatttctatcatatcacagatgacttccctggatgccagcaccagattcatcccgtcatgtccctgcgcgcatccgtcacaaatatccgtcacatgaaacctggcgggatgccctcctttttcatatatgccgtatactgcctgctctcccagttggttcaggtggatgctccccggatggctgtcgccataggcatcctctaccaaaatctgcggtttgccgatgtcctcttcatcccatccgctccccaattgcagggcatcaaactgtgcccatgtacagcgttccttttcactgcgtattcccatctcatacctccgcgcatttatctgtatacctgtattacaggtatgtatataattaacgtaaacccgatgaaaccgtatgtcaagaaaaatagaaaaaagcgcatgtattccttgtcagatgaaggaaaatcaggtaccattgtttagaaagaaaccttttattattatgtagtgtgggaggcgttatggaagatatcattattgttgataataaactgcagccagaggatttcattcgtttgcggctggaagccggctttatggaaacgccgatggaacaggctgaaaaagctctgtccaacggcctttttaccgcatctgcaatgtgcggtgacaaaatcgtgggaatggggcggcttatcggagacggttctatgtattggtatatccaggatgtggccgtcatgcctgcatatcagggccggggaatcggcaaagccatcgtgacaaggcttatcagctatgccgaagcaaacagtctgcccggcagcaaggcctccatcgggcttatcgccgccaaggggaaagaacccttttatgaaaaaatgggatttgcaaagcacccccacgatacaagcggagccggaatgacaaggaaattcattgctccggattgtactgctgataacaaaggagcttccaatgaattcttccaatcataatatgtttataaaaattctcctgtcttatctctcggttctcgcgatcccggttctggcaggagtcgttatctatcattccgcactcacttccgttaccaagctggtcagggataattctcacagtatgctgagccagagtgtggctatgactgatatccgtctgggagaactggaagcacttcccttctatttaaaatcccattctgatatgatatccgtcctgagccggaatgaaattgcggagggaagcaccgaattatatcaggtttacagggcttatgctaatttccccaaattttccctgatcaattctctcattgccgatatccagatcatttcgctgaataatgattttgtcatcagccaaagcaatgccctgcggcttacggaacaaacctatccttccatgtttgcctatacaggcatggattatgcttcttttcagacctacttaaatgacaatcatttttccaataacttcgttctgttcgaaaacagcaagcatgaaaaaacacccgtactgttgtcggatattacctacgaaacgtctccaagcacgctggccgtcgtcatgatccgtctcaaggagaattctcttcagcatatattaaaggaacttctgaccgatcaggacggacttgtatttattctggatgaaaataatgaaatgatcacttcctttatcggaggaaactgttctctgtccctggaagaagcttcttcttatatcgatcagaattcctccaacgattccgattatcaggattacatcgtcagtatgctgcagtccgattataacaactggaaatattgtattttttcttcccgcagcgtggtaatggaacggatggcttccacaaacagaaaattactgtactctattctcgcaggtctttttgtgagcattatatttatatattttctgggccggaggaaaaccgactctttgaaaagggtgctgaattaccttaacggaggcccgctgtttccctcctctcatgatgaatattcttatattgcggattctgccgccaaattgatcaacagcaataagaaactcaggaattcccttcagcttcagaagccgcttcttgacgcggcctcactcagaaaccttctgaccggggccgtcagcaaaccggaagagcttcagtatctgttcaattttatggatatcagacccgacggacagtattttgccgtcatattgatatccacagagcttcctgccggtgaagaatattctgcctatacggaatatccgcttctgccttccgccctggtcagagaatatatcgaaaactgcacggagcccaccatcttctgtctggacattgacagcacaaaaaaagccgccgtacttatcggaaaccagatggaaaaggatgctttccggcagcagattatctccttttccaaacaccttgtcagcaaagggctggaagacggtaaactgacactgacatgttttctgagcgatatctgttccatggtggatgaacttcctcaggcatacagacaggcagttatcatatcccagcaggcttcccgccgtcagggctgttctttgtataccgcagaggatatcccctccatccagcggttctatttctatcctgtacaggtggagctggaactgatacgccttatcaaacgcggcagccagccggaacttcttctgctgcttgagaatctcaggcaggccaattttgtggacagaagtctttccgcctctatgaatacacagctgcttttcgcgatatacggttccatcttgagagggctggatgatcttcccaaagaaagcctcccctccaaactgctcggcagactgcagaatccggcttcttttgatgaattggcaaaatgcattctggaattaaaccagcatattacgcatatcagcactcagcagaatgaagaaaaaaataaaaagctggcgcagaatcttctgcagtatattaatgaacattatacggactgtgatttttccatctatcatatctgtgagaatttccatatgagtgaatcctccgcttatcaaattttccgggaagtgataggcacctctttcacaagccttgtggagcatatgcgcatcgaacgcgcctgccagcttctgaatgaaaagaagctgctgattaaagatatttcggccgctgtaggctacagcaatgataattcattccgaagggcattcaagcgggttatgggaatcactcccggggaatatatggagcactgaccgtattatccggatccgaaaggccccgggaccatgcaggcaaaagctgcggttccggggtcttttggccgtccgtattatatcttatatttttgacatggcaattttatcgtacagttcggaacactccagggtacatttatgggaaacgacttcgctttctgtctttcccgcccggatgcagtccataacctcctgaatctcatatgtaaaaccgttctccgtttcttcatcccggaaatgctctgtaaccctgccttccctgtcgcagaggaaagcctcatcagcataatgaggatgcgggatcactatccttccgtcctctccgtaaattatgattctttcatccagagccgcccccaggctcgccgtcatagtcgctgtcatatccgcgaaccggagcaccgcatggtccgtcaaatctgttcccgtagcttcccacaaagcgactgcccgggtatccacgatttcctgaggaaacatataagtggttatttcataggcgtataccataatatcatgtgcggctccggcgcccagcgcgggattatggtaacgattttcatccccgtaaggagccaaaaagccaatcgtggcatcactgagcctgattctgccgatacgcccttcctccagccactgctttccttttctgacagcgggcagaaaacggctccataaggcttccatcacaaaaacattctgtttctccgaacgttcaaataccgctgctgcctcactgctgtccataaacattgctttctcacaaagaacaggcatatgatagtccagacacagcatacacagttcaaaatgtgcattcggcagaaccgcaatataaacacagtctaatttttcattctccagcatctcccgatagctgccgtaagccttcggcacattgctgctctgcgcaaacttctccgctttttccattgacttgctcgacactgctgcgacctcgcagttttccagcctccttaccgcatcacagaacttaacggcaatctcgcccgctcccataatcccaaatctgaaattttccattttaatctccattccgccgccgtatcataaactgatacctttgattctccgtttcttttatctgatatcgtacacgctctttacctgaagtccttccggctttccttccagtattttcacacgccttacgcccgcatccatatcgaagtaattatcctccaggcgcaggttatcctctccgttaagaatccgaatgcttctggcatagcagccgacagtaatcaccagctcgtctccttctctttccaccctgagtccgggagcgcggaaatgaaaatatttcggcgcgcagaacaggaccgttcctcgggaacatacgtttccgttttcttccattctatagctcacataattctcataaatatcagcttccggcaaatccaccttatccatccagaccgatgacagaggcggcaatgaaatctcataatttccgcttctgaggattccggctcccgcatccctcagttcccagctgattccgacctgtttttccatgagtgtttcgttgcttgcacacaaagtaatagacttatgcagttcatagggctgggcgtttacattgggatcctgtgtcagcgtgctttcttcgctgcaggaaagcagaagaggcgcaaaaaagcgcttttcaaaatagtgcagagccttccatcttccgaaatagtcgatggaagaccagcttgccgcgggccagcagtcattcagctgccaaataatactgcccatacatctgcctctgtttctccggaaatgctctactccgtaacgcatagcctcagcctgaagcagctgggatgcatacagtgtggtatcaaaatcattcggatacagaaaggtctgttccatataattcatgattttaccgttagctgaggaatttctctggtgcttttccatcacataggaaaaaatattccgatctctcggttccgtgaacgtttccaccgttttcagcgacgggaaggactggaagccgaattcagacacatagcggaaaaagaattttctgtattccgtaatgggttttccgccgtgccatacgtcccagtaatgcacatctcccctgttttcgtcattaggctcatcaaaacctcctcctgaggacgggcttgccggccagtagaaggtctgagggtcacattccttaagcactttgggaataatatactcaaacatttttatataatcgctgaactggacaggattcctgcaccatccttccctgttttcagcaataaacatttccatctcattattgccgcaccaaagccccaggcaggcatgatggcggattcttctgatattgtcctcgaactctgccgtaatagtttcctcaaagctttccgtcaaatcatatacacagcaggcaaacataaaatcctgccatacaatcagtcccagttcatcacagatatcatagaaaaaatcatccggataatagccgcctccccagacacgcaccgtattaaaatgagcatctttggcagactgcagcaaacgccttgtgcgctccctggtaacgcggctcagtagattatcttccgggatgtaatcagcccccatggcgaaaatccttactccattcacctcatgggcaaaagcttccccgtattgatccttttccctgctgacggtcatggtccgaaggcctatccgccgttcccaggaatccagcacggtttcctcttccaaaagctccacccgaacggtataaagaggctgttctccgtaacctgcgggccaccagatctgaggctcccggatgagaatctgctccgggcttccctcataaacagttttttccttctgcggagtgataagggtaaccctgtagtcagacgccgcctgtttaacccggatatctgacctctccgcaggcagtatatcagccttcagtccaagcgtgactctgccgtcttcatgcttctgggttatgtatacgctttcaatccgggcgcggttcacgcctttcaggctcgcctcccggaatattcccgcatccgggatacgcggtccccagtcccagccgaacatacagtgtgcttttctcagccggggcagccccttcatggcatccacacagccctcgatcggttcctttgcataagagtcagcgataaatttcgtaggagaatgcagtatgacacgaagttcgttctcctgttcccgcagcatatccttcacattgaattcccaggtgcggtgcatgttatccgtatttccaagaaagctgccatttaacagtatcgtggaaagggtatcgatcccgtcaaaacagagcagcacctcatcacaggcaagaagctctgtatcggcatcaaataccgtccggtactcataatcatgttctataaccgcaagcgcttccttttcattatcccggtaaaaaggatcctgcatccgtccgtttgccatcaaatccgtatagacactgcccggtacctctgcgtccagatactcctcccaggatacttccttcatcttccatccatcattcagtataagcttcctcatccttgctcccatctgcgcgttttggcgcgtcattatcgtatgataccttctttccgcctgattatatctctttgccggataacagtccagaacatgaagatttcatagtttgtctgcaatttccatcaggcgggtgacatctgcttccacgagttttccttttttatccggcggtaggtttatcacaacgatattttcttcttcgaataccatccggcaaagggctgccgtttcctccgcatccttcaaaggagccttttcataggtgtctttatagaaccagctgtcgccttcacgggagcagatagtcatttcaaagggaagatagtattcctttccttcaaaggtatatattttaggatctccttttctgcagggatgaggatcccagagcctgaaatccgatgggaacatacataagggatctccctgcctgcattttgccgggaggtactcctcatcaggcattgaggccttatcattatccgctcctacggtaccgttcacgcctatctggcatcccggctgcaggcgtttcaccagatcatagattctgtccagctgccactgccttctggtcttatcccactggccatccagccacagttccacgatttccccgtatcgcccatccatcagttccgtcagctgctccagcatataagggatataaccactgtcaaaatcctctttgtactgcggcgcatttctgtcccaaagggaataataaagtcccagctttattccgtacttacggcatgcctgcgctgtcttctccacgacatccgtcggattccccgaatatttcacgctgtatttcgttgtgtccgtatcccacatgcagaagccgtcatgatgcttggtcacaagcaccacaaaattcattcccgcctcacaggctgcccttacccactgttctgcatcaatctgttccgggcagtaggcttgtgccggtatacttccgtccgaccactctacgttcccgaaggtattcactccaaaatgcagaaacagcccgaaacggcgttttatctgctctatctgcccctgagagggatgccgggaaggaaccggcgcaatctttgctgttttcaatccttatgcctccagacttttatatccgccgcatgacgcttttcctgcccatgcggcggatatctgtaaattactttttagttatttatatattctgtcatatgctgtctggtatacttccaataacctgcccatccccatatcttccagaccttttacataggtatcccagtctttatccagatccattgcgcctgttataaactgtacggcactttcctggtaataatttttaacctctacggacatggtctgaatttcctggctttcgtctattgtcagcttcaatgccgtgggcaatgtctctacatcggtcggtttgtgaggctcatataattcctttgttgcattgtacagcatcttttcctgtccttcaggactgaaaatatctacatcaggatctgttgcctccccaaaacggaatgcggagggccagaaatcaagacctgcgtccgtccatacagcattctgcggttctgtagaataaggacgatatttttcatacagtgcgggacttccgtcaagtcctacctggccttccttcgcgtctccccagctgccttctcccttttcgccgtatgtggcggtcagcgttccctccaggctgtagagataatcaatcatacgcgctgctgcttccggatgttcgcaggcgctggtaatagctgcggcaggatatacttcggtgggaacataggttgcatactgcacaccttccggccctttcaacggctctaacggataataatggctgtacagttccggattggcagtacggtcgatgaagataatgctggcgccgcccataacaaacagaaccggctctccttcacttgcaatcaaagcttttgcctgctgatcatccagcgtaaaggaaccttcatacagcagtccgtcttcatacagctttctcatgtacctgaggccttctctgtactcctctatatttgccatagtggacaccgtgccatcagcaacaaccattccgtgaggagactgattgccgggatagtaagtgaacgcattggtgaagtaggataccggattgccattccagtaagtacctcccagcacaggaattccattcggatgctgctctttgtacgctttacagatacggtagaaatcctcggtggtagccggaacttcttctcccatttcctcaaggagcttggtattcacccacattttgtgggaataggttccatgatatgcttcgttgaaacggggaaggctgtaaatcttaccgtctgtcgcagtgatctgctcccgcagtcccggcgtctcatccaggaattttttgaataccggcatctgtgtttctatcagatctgtcagatcaatcaggctgccctcttcaataccgaatcggttttcatcgggtaccgtatttgaattgcctacaaggaatacatcgggcacatccccgcccgtcataatcaggtttaccttttctgtcgccgagtcactgggcgctacttcaaattccaaatcaattccggtcatctgttccagatactgtgtaaattcattggtgttaaaatccgtgatagtcgctgactgaggcgcaaacacacttaatgtaaccggctctgtcacgataggataggttcccacctcagtgtacaggccattgccgccattatcagcgctgctctccatattggctccgccgctctcctgcgtcgatgctgccgcatccgatccgcccgtctgattgccgcagccggacagacataccgctgctgccagaatggccgccgccccttttgcccaaaatttccttctcatacttaaatcctcctgtatgtttttttatgaatcaataagcttatctgcttatgatttttaatattgtctcactattatcccttcagagatcctatcataataccttttacaaaatgcttctgtacaaagggataaattgccatcatgggcagactcgccaccacaattacagcatatttcaacagactggacaacccctgcattctctgcagtgcattcacatccgttatcatcgtcatatccacttttcccagcatcagtatttcacgcaggacaagctgcagtggatataactcctgtgatttcagatatatcattgcattaaaatacgaattccagtttcccactccatagtacaggaccagtaccgccaggataggggccgataatgggagtactatttttaccagaaagcctgtaacactgcagccgtccagctgcgctgcttcatacaattcatccggaatggtactctgcagataggttcttgctataattacattccagacggacatcgccaccggaatgattaccgccgccctggtatccagcagatgcaggtttttcaccagcagataggtaggtaccaggcctccgctgaaatacatggtaaaaacgaagataccgcttataattttccggccgagaaattccctgcgtgacagcggataagccgcaagcattgtcatcgccacatttaccgccgttcctataataagatagaaaaaggaattcaaaaaaccggacacaatcttgggattcttgaaaaccgcatcgtaaccaattaaagtcggatccaccggcagcagaaaaacctttcccgacgacaccgcaccggggctgctgaaggatgcgcttatcacataaattaacggatacaggacaatgatcagaacaaatgtaaggaaaagataaaccaatcccataaagactgtatctttttttgacatttttacttttttttccatttctattccctccttttaccagatactcgtatctgataccttcttggcaatcgtattggttgccgtaagaagaataatgctgacaactgcattgaacagacctaccgccgccgaaaaaccataatcggcgttaacaagacctaccttatatacaaaagttgcaagcacctccgaagtctgctgattcaccttattctgcatcagataaattttctcaaaacctatattaagcaccgaacccacattgaaaatcagaagaacgataatctgtgtcctgatggcgggaaggtcgacatgccagatacgctgcagccgggtagctccatccacaatggccgcttcctgaagttctctgctcacccctgtcagggccgctatgtaaatgacagaattgtaacccatgctctgccagatgccggaccatacatacaaatggtcaaacagcttcggttcccccataaagttaaccggggtcccacccagaagtgtaattatctgattcacaattcccagccggagatccagcacctggttaagaatacctaccagaaccaccgttgaaataaagtaaggggcgtaagtcaccatctgcactaccttcttatattttttggcagatatttcatttaccgctatggcaaatataatcggtatagggaaacccgcaatcagggaatacaggccaatcctcaatgtattccatatgatcctgacgctggagggggatgagaaaaactgaataaaatttttcattcccacccattggctgtggaggagtcctttactggggctgtatctttcaaatgccatcagtacaccaggcattggtacataacagaagataataatgtaaagcagcggcaaggctatcaacatataatattgccattgctgtcttatcagcttcttcagattctttccttttctttttttaattccttccaatttcaaatccctcctgctgttgcttttttagttccggtatcgtggtatattcctatggaaaagcttcctcattccacatccgcctgtcttctttaccggttgtaccaggaacctgttttgctaatttcgataacgcaattgtacgtctcctctcttcaaaaagtaaacctccaatcccaaatccggactctcatttccgtcattttttagcatacattttctttttcagcttacattttcttctttatttgtataataattatactttttaataatttttaatacatgttacacaatattcaatttctctttcttatcgaatccgtacatggactttacaacagtattccccaaaaaaaccggctgacaggaagtatatatatctctcctgtcagccggcttttatttcatttcaataatatttgctttttttatataaattctatttctgcaaggccatagggcagatccttttccggatcaataaataccccgctgtttgtcaccgcagaagggtcttttatttccatggaatgaagcagtcccttataacctcccagcaaaatgatatgatcgttttccaaataaggggataagttctcaataattgtatgtaatttcttcgtcatttcttccttatattccctttttgcaagttcgctgagatattccaacatttgtcctattttgattttggctgacttattggcagcggttataagtgcattcgccgaatccctatcaggaagaatcaattgaccctgcagcggactgtccgccctgaccatttctactccgacattgtcaaaaaacggcgcgaagcatgcctgggtgttttcctcaagatactgaaccttgtaaatattccgtaaaacaatatagctgccgggaatcagaatatcatctgacatcaatccgccttctacagaagttccgcggcatagcgcaccttttaccgaagaacccggcagataatacgccgcaccttcaggattgtaagcagtgtatatcccatactggtaaaaaggatagattacttttaatctgcttttcgctaaatattcagaatcctccaccttttccaaagagaattcatctaaatccctgtaaaaggccaaagcagatcgcggtgatacaattaaaccggaacaggtcgttaattgataagctattgtttccataatgaattatacctgcctctcactcaaatagattggatacagaaatgcatttccaaaaacgatatccctgttttggcggaagggggattcgattgattttcccgcatgccccactccttcacggaccactattatactgccctgctcaataaagcttatgtaatatttaggcgcatccttcctccagccccccgtcatctcaaaaggccgtctttgcgatgtgaataatttgatggaagaggccttaaaatctatgctgtcaggcagcagcattcccgtattcaggtaaaatgccgcttctgcccctgaacttttctgttctgttatttccataaactgaaaaagatttaatccctgtgaagctctttttcctaatattatcatcttttgatccgccgccgcgtcctctgtcattcccagaaaatcagagcacaaactgctgtcatccacttgaaggaaataacaataggtatctacagggcgataatgctctctgccttttttgtcctgactaacctccgaaagtaccactgtaggcactgaataaaggcgtgtatccaattccgggatatcatagcagacactgtcaatggatgcacgcagctgctgcagatccagctgggtcacataagggaaaagaaactcactgctctccggcttagccagaacatgttctaactcctggctcttaatatagctccttatttttatagcagcatgcttttttttcaattcttcagccagattgttctttttggaaatatgatccatcaagtaatccttaggtgcaggcagataaccttccggcataatattggacaaagccaggtgtatttccttatttcttacagcgctggccaaatcagctgctctctcatctccatacttttctgcaaacatatacatcaatgcaccaaacagcttttgggaatccggcacctgtgttatggggccggtcaatttaaggataactttataattcctcatgcatctgctctccatttttatccatcataaaatttccactctgccgtatccgcggcttttggaattaccaagccgataaataccttcgttaaatttcttcagattataaatcagatattccttacaaagctctccggcctgatcgcccaatttttccattttgtataaccttatttctccctcaaatacaattccgcttcgggcagtctgataggtccggggcttcgattcaggagcattaccacgggtatcaattgtatttttcatatcaatggaaaaacaggtcttcttatcacggaattcactgcataataataaatcgccaaaaagcagtttaggagtattattaaagcctttgattccaaacagatactcgggagacacctcattggcagcttccaaatatcgttcttcaatcctcttaagggcttctttatcattaataatcgtttgaatttccggccagtttttctccttttcattaatcagatatttcgtaaacaatctgttgatttcatcagccatcgcactgtcatcctcgcgtataacagcccgcagggctcctttcagcgaagaagcgggaatacagggaaagccttcctggtcagtggctgtctgttggtctattccgccgattttaaaaggtaccggagctcctccgataaacagattggaaagtgttttcatttttatggtaatcgaattttccatttagctatacctgcctttatctaaaacaatttgttagttttgtactgaatttctatttctttatactcataaagcagcataagggaatccacaaaatcctcattccataatccgttctggtttgccgccctgcaaaatttttctttatcaaaatatctatagcaaggcgccttccccttctccattctctgcttattctgttcctggattttaatttttgtttccaaatccgatgggttgtgcagttcaatcatctttgccgccttttcaacagaaatctttccggtatcgcgcagcttaataaacatactcttttcgattttaagccgctgaagacactgccttttttcccactttttcttcttttctatttcataagacactttatcaacaaaaatttctctcaggcggttatttcctttcagcgcagtattgtacagataatcgagcggcttgcttgtcaaatacttacgggcattcttcaactcgtccttttgaaatgcggccttttcttttatttcagaattacccgctatctgaaaacgactgtcggaaaataaaagcattaaccttaaatatgtttccaaacgctgttttgtgtctgtgttaactacgatttctgcgccccgttccttcagctgcaataactgctgaataattcccccatttaaaagcagctcccatttctgcagatccttatccgaagcatcgctaaactgaggtaaaagatgatataaaacactgttcatatattcaatatcattttcctgcacagtttcatcagtaagcctttccagcaaagtatagtaaaatcccgaggttcctaataatttatgatatccgttctcctccgctcttaagtaattcaaacgatttacatctgtcaggaaaaaattccatatggggatagattgtaaatcacttttaatcgcccttctttttttacagttcgggcaattaaaccggtagcctttatgcgtgcatgccaattgcttcttatatattttaagtccgggataatcgatatcaagataggtcataccataaattgatatcttcattctcataaattttttaagagatcctgaccatgctttctttgcatttttcaactgccgttccaccatatccatatagtatcggactggctctctgttaaacgtaatttctgtgccgatgctcatggttaaccttttttcagggaacaccttttccagtttatcattgatatttttcaggatattacggcatatctgaattccattcatcaggtttgcagccgagacagcaaaaaagatatcatcacctgccatatagaacggaaaaacccagccggaacgggttgaatcacattcctttacccctttatgcaatccatttaaagaaacttcctcatttaagattctgcttacccaggaatattcgtcatagcttttgatgtttttaaacatgtcacccataccatcgagatcggcctttatgacagctatccggaaacgcttggggttatccgattcttctgcagaatacagtgcattgatgttttctgcaaaaagtggatattccattttttcaaatctgcttttctcttcctttacagtacagaacgaaaagagtatctctctgtttctttcaatccattcattaaggctgtccgattgtttaaggcggttctttgcctccagaatggcttctatttcagtaagattaccagacgggaaagaaatacatctcagcattttctgtccctgtgaactataataaaaatgtaaaaaaagtttattcagcctatctccgatttcctctgcagacaatccgcattcaaaaatgtatacgccggagcaggacagtaattcttccgtttctgattttggaaatacttcctgtacggtttgataaaagcctatggatatttccatggaggcattcataatattctttaacgtagtctcttccgcctgcttttcctgtgtctgtgcatgaattacttctgtcaaaaatgtctgcaccttatcaatggaaagtgctacaatccgtctgtcactcatgattttccgctccttttgcgaatttcttaaacatttcagcatatgcgaaatgtggaaagggtattggattatttgttaagatgtaattagttattatatacttaactgttttactgtcagcgagatcgaaatttcttatttcttccatacttctctctctcgtaacctgtggagctacaaagtcaaataaattccatttttgtccgccccattccaaaggttgtattccttccgaaatgtacaatctgggcagcatgcagccagggaacaaaaggcgttaagtccccctcaaaccatatatctcccaccaggccgctaaagtccatttttttgcccaaacgatttgaatatctctccatgtttaatatttctgttttttgtctgataacggaaacatcttcagaaagttccagaatacggcctatttccaactgatcgcaccacccgccatagcgttccgtaatcatttctattcggcgggcaatattacgtataattgttgtaaaatccagttcttcaagcagatttccgttgcggcgtatgcgcaggggcgtgagcatttgaatatgtaactgcgaaacatccggcagacaatggtaaggcaacgcagcacttctgattgctatttcatagaaatggcctttttcccaaattattcgttgatctaaactgtgcgtaattttctttaattcgaacttatatcttgaagcacccaatccaagctttccaatttgctgtattgcattcactaattgtcgggcatattgtactccttctcccagaagaagtattttgaagtttagctcctctttttcaaaatatatttgcttctttgtatcaggaggaatgagcacatacggattaattatatcttgcatattactgctcattttgccgttgtgatatagataattgtaggcattcttatcctgaaataatgcctgtccaatcacaccgcgaagggcagaacccaaaaaaggaggtaattcggccctttccagggataccaaagttatacttattggcaggtaattcaggaagaaagaaccttcattctttcccattttttcacctcattttgtaagagaatgtatatgtattataaatcgttttttattttactataaataataattgccaaatgtcataagggcgaaaatgtgttgtctattggatgtattcttttatttcttagatatataaaacgacagcttactattggataagttttaactatgaataatatgcaatttacatcaatgcaaggtgcgacttcttagggatactgtattactatcatagtaaaatacccgcggaaccgtatagacttcgacgtgccaatgtgatgggtgctgtgtctgcggcacaatttcaatccacgaagccgtataggcttcgacgcacagaaggcctataagttccaacggaaaactaatttcaatccacgaagccgtataggcttcgacagctgtgccatattcgaagctgatggtggagcctgatttcaatccacgaagccgtataggcttcgacatagaccgcatggaagcggcaacgaattaggagatttcaatccacgaagccgtataggcttcgacgttgttttccgtaaatatgcggttacattacgtatttcaatccacgaagccgtataggcttcgacaactgcattacaggatagcattccgtccacaatatttcaatccacgaagccgtataggcttcgactaaagcaggagctggttggtgtctatcctttttatttcaatccacgaagccgtataggcttcgacgcaaattcatcatattcttgctcctgcagaggaatttcaatccacgaagccgtataggcttcgaccctgcaggtagtattccgtggcctgcgccgtccaatttcaatccacgaagccgtataggcttcgacagcaaaaatatccaaaaacaatctcataacacaaacttaattatatacttattatattttccacctcacaatatctttatataaattattttcaatctcttccccattaaaacaactctttttcaggtgcgaatctctcgggaatttcatgtgcacttcctattcgcactaacaataactctgttcgcaaatttcataattgaacaagtacttttactcaataaaactctaatcatgctaacaacaaactattatatgattataaaatttattattcttattccttatgctataacaacaaaacagtaatgtaaagtcttattctatgaatcaaagtatagcataaataatttaaaatgataagtaactttcttcactaatccgcaaattacccaaagttcatttatacattcacggagatcctattcgtaagcatttattttactttatcattaaaaatattacttcaaaatgtaattcatatttatatatcaagcctccttcattcagtaaatctccatctacttccacctaaaaccttttataatatctacatcctgccataataacttatccatgaaaattatgattaataatggtaatctttctaatatattttctatccgtgacaaaacaagacagactggtaacgtcatttgcttaagtattcataatatatttatcgtgttccctatctcaaatcatactcttctctatgaattcccccatcgtattgcctacaaaaaatgttatggcaatatacttaggagatttacataaataccctaatcgcaataatatatttcctctcaaaacaccacctgcaaggtggtgaccgggaacagtatagtaagacaattgctcttgtgatttcaatccacaccacccgcaaggtggtgacttggttcaatggtgattgtaaatccgaggggaaaaatttcaatccacaccacccgcaagatggtgactgggagccattcccggcctgcggaagtggatcgatttcaatccacaccacccgcaaggtggtgacttgcgttcttgtttggagagtgtatccagatatgaatttcaatccacaccacccgcaaggtggtgacttaatcaaatccaaggccaccatatccgtcggggtatttcaatccacaccacccgcaaggtggtgacggcatgccccatatactccacggcctgcttgataatttcaatccacaccacccgcaaggtggtgacgaatggatgtaaatatataccctcatattatcagatttcaatccacaccacccgcaaggtggtgacaactatatgctcattaagcataaagttcttccagatttcaatccacaccacccgcaaggtggtgactggacagtgtcggtattgaatatgaaacggaggatttcaatccacaccacccgcaaggtggtgacgccggcagacccgtcagtgggtgttggccgggagatttcaatccacaccacccgcaaggtggtgacatgtgataagggggagtatgtgatcatcgcaggaatttcaatccacaccacccgcaaggtggtgaccagagggagcgttatgtaagggggttccggttcgatttcaatccacaccacccgcaaggtggtgacggatacatcaagtttctacggcatatttcttgctatttcaatccacaccacccgcaaggtggtgacctgtcaatattgaggattacaaccggataaagaaatttcaatccacaccacccgcaaggtggtgacaataacatggagcatttttgtctgggcggaacgatttcaatccacaccacccgcaaggtggtgacgaagtgcctgcagatatgacctataagcaatggatttcaatccacaccacccgcaaggtggtgactccagattcttgtcgatgtcagtaagcttttcgatttcaatccacaccacccgcaaggtggtgacggtcagcaaggtctgtcgcatcggaaccggcctatttcaatccacaccacccgcaaggtggtgacaactatagcaatagccagcacaaagacaatctggcatttcaatccacaccacccgcaaggtggtgacagggtcagttatcttcacactattaaaataaaaaatttcaatccacaccacccgcaaggtggtgacagcaattttgcacaaaaaccactcttaattcctattcatcttcaccaacaatccacacccaattcactttacatcttacattcttccacatcaaagatcaaccccaagcaatatctcatcaaaatcccggtgcgaatcccccggggatttcatgtgcgcttcaggttcgcactaaaagatcagaggctcttccacattaatccccttattcactccaacatgttcaacccgtgccttattctgatttcccaaataataaaatctgagactatccacattttcatcaatcaattccgttaatgcagctttcagcattaaacactgtccgggatccagaacacactcgaatacagaattctgtactcttgttccataattcacacattgctttgcaacttttcttaaccgggacttacccgcggcagtttccgtattcacatcataagtaattaataccagcatgacagcctcctatttccagaaaaaaggtggatattcatcaagatcacctcttagatatcttgcaagcagcatagcctgtacaaagggaatcataccccattctactttttcccccagaaaaggatgcgtaattacctctttctttttgttttgccattctgtcagcagatcttttctggaactgtcgcttaacagcaccgctccatcttcttttttagtaaaatcctttgctgtaaccatctttttgttaataagggttaaaacaaaacgatctgccagcaccggcctgagttcttcaattaaatccaaagctaacgatactcttcccggcctgtccgtatgcataaaacctacatacgggtccaggcctaccgtttccaatgcagacgcaaccatattcgtaagcaaggtataaacaaaggaaagcatggcattaacattatcgagaggaggccttttatttctgccggaaaacacgaaatcctttttctgctgcagaatcagctcattaaaaactccgaagtacacactggccgcttccccttcaaaacctctcagctgtgccgcatcaccacacacttctatattacttaatgatctctgtaaaaaatccgatgcctgctttactttgtccacatctatctgcatactgtgatcccgaaccgcacgttccagaacccatcgggaattataaaccttgccaagtatgcagtttcttgctatccccagggctgttcctgcatccgccgaaacctcgtactgctttttcctcaatagaacatttccccggacgccgcctgtcacccttgccaggaatttaccctgagggctgagaaagcatagggaaatatttctgcttgcacagccgcccatcagagaagggctggctcctctgtaaccaaaggaaacaatcgcttccaggttatgcagcggaatccgccctatctcctgatcgttatcaaggatcaccacattttctccatccagtgaaagataactgtcaggagaagtgatatataaggtatttaaaagcttcttcattggcaatcctccgttattgcggcatgaatatactctttcacattcggcgtttttcccagtttaggcaggcagatgtctttaagtgaacaggcattgcagcttttagaccattttacctttggtgtatatcttttatcatagagctgatgcatctggcagaagcagtcttttacttttttcttaagctcatctgtgaaaagaatattttccctgcgtctggtctcaccataaaatattgcaccttcctttacttcggcggagaacatttcttccaggcacagtgcttgtgctgtcagctgcaggatatcggcattgccggcttttgggctgccttttttatattccaccggatatacctgatataaaccgcgatgcccgtgaagagatattccatccggcacctttctgaactccacaatatcacattcaccactgactcccatactccgggaaaccaccggcatcgctctgcttataattatatctttccgcttttcgttaaaataaggatcatgcgcattcttatgaagcagttcccccgctgttgtatgctcattttctgcccattgctgctcaatatgtatcagcgcccattgtctttggcaaaaaacaaagtgctggatccctgacagcatcaggtaatcttcttcttttatttccatcatatttttctcgatatctccaccgaatccggaaccagctcttcatgtatggcaacagaataatctttatactgcctcggataaatcacatcctcatttttcttgacctcaaccgcatcaaacagtttatatgcggggcagtcccccaactctttactgtgtttgaaaacaattaattccctcacagccatctttcctctggccgccgaatgatcaatttcaaacatattaataatggattcccaaagcagttccaaatcctcttctgaaaaaccggttactttgcgggcaaggttggcagaaatatatccttctgcacgatagagggcatatggaacaatattttttcttcccatttccgtgcttttattttcagcatctttttccgtggtaatcgccacacgggtaatcgttacttcctggcttatgatcggatcaatactccgggcaaatcccagctgtaccggaccgcgtacctgtccgcagtttaacgcggcttttacaaatgtggtcataactgcgccaaaggttctgatatcatagaaattttcgcacatgaaatcacggatttttctgtccacatcgggatctttcttcttcagctccttaatatccttttcattcgtattcagatattcataggccgtattatcgctgcggtttaacggcacatcttccttaatataaattttatagccttcgctgtcttcctttactgtctccacataatttcggatcttccttttcaggcagacatccgttacaattccatagccgctttccggatcaattctgggcaggttgccggcatccggatccccgttgggatttccattctccacatcaaataatatgacaaattcatacctgttttttattgcttctcccatgttactgctcctccttatcctttttttcgtatcttttttgtgtctggtgatagtagcccagaataaacattccctgctcatccagcgtcagtctcctcggataagctgcattcatatcttccgccgccgtaattttatcctgaagcccgcctaataatttttcgtaatagatttctttccctttgttattcaactttctgatatggctgtttttaagcttcagcaatacgggaaaaatagaagcgggtgtggcacaggcagagttaaaatatctgtccttgatcgtagcgttgatacccggattggcatcctcctgaatcgcttccagcaccgcaaacatccttcccagggtgtaggcggtatttttactgtcctcgttaagggccatggtgatctcctccttatcacaagtcgtatttctcagaagaaatgccttgataatcgcggctcttccccgtgttattttataaataccaatgctgctgtcatcctgttccgaacggattctccccataacggaccggaataaagaatccggatatctgtctcctgaaataatcgcccgataaacagcgcctgccatattgggaaccggctttttatcccttgactttttatttaccgtttccatcagcatacgccagactcctaaatatttgattccgtccgtctgaggcctgattatgtccatcctgtcataatgtgccttcagattcttcagaatatttccaaaactgtcctgataaaagaagcgtacagctattcttgcggcattcggcgcgagtcctaaaatatagaatttctgagacagggataaattttccgcaacaccggatatattaactgcctttcctgattccaggtttttaaaaacaccatccacaatttcacaattatccatcgtcggttccgacatgctcaaaaagatatcctgataggcttcttctccatcctcagaccaataaactatggtagtatcacctatcatagaaacatgccgcctgtccgccagcagatgattcaatgcggtagtataagcataaaccgcataatttcccaccggagcgttataactctgctccttcccgtaagattcaaatgcaggtgcattaaaggataccagagccgcaccgctggactgtgctccctgtacacccttaatatttccatgaatccgggcgatttctgtcttttccccggttaccagacaggtacctgttattccttcctctaaattctgacggtaattctcccatgcctccactaccgctgtatctgtatgtacatactcatcttccacccagaaaaccaggttagcaccggcggtaatctcatccagaacttccgaaaccaaacaattctcttccgccttatccggatcccagctttcaaaataccgcttaaccgcctcagccgcaggacaatccgtttcccgcagtatttccaaatgtttctcctttgcacatagaaaacattctctggagcgttccggttttcctttattatcaattcccagaaaataactggaattatcgcataagaaattagcggttactccggaagaacgggtgagcatctgaggaactttaagattctgcggttcccggaccgttttctttcccttcgtaacctcattttttaaggaaataatccgttttaaatctccattcggggacagctccagcgcaaaggatacccgtgcaatgcaccagcccggccgggtaatttcacctttttgctccagcgcctcatagtactgtaccagtgactgcaggatcatcgaaccacctcacaatccctcacatccaaaactccgttttccaatttagccctgaaaaacatgggctgtatatcgtccggattggagtaatcaaaatcatacagcatatatcccaaatccctcacctctcccggataggccgtatcaatctcatcctcatcgaacagagcaaaattggcggggaactccctgcatccaaaataaggcatgtgatagcactcccccttcctcagccgacgcatgataatatccttgaattttcccggattatctccggcagcggcacgttctgtcatttcaaaatgagcttctatcacatattcaacctctctcagcagaattgccgctctttgcacaatctcctccttgctgctgatgtaaagcggcttttcgcctccgttcataactgtcaggacattacttgcaagaaccttgcttttcacctcgtttctgcggacacttgtaaaacggatcggctttctgacatagattttatcaacctcccagcacattcccggatgccagtatattgcttccagaatccctctggctgctgaaggtgtcatcacatcgtagctgcaccgctctaccttcatttccggacgtgaaaagagtgccagttctccccacacccgcacttttactccatggctcatgtatttcctcctccctttatcacggtcaactgtatttcagaatatgactgcatctcctctttccacctctatctgcagtcccatttcttccgtatactgttccttatttctcagtataaaaaacccaagttccagagcttccaatcttcctgccccgttcaatttctcaaaatcctcttcatacacgtttacacaatattgccctatgtctctgataagctgacgggagcattcccctcttctgagccgctccaccagaatttccgcttccggatcccggtctatcaaaattgtcctggtattattttcaatcagcctgaactgttcggctactgcagcaaaaggaaacaggaacgattttccacccgcttccatttgttctataatttttttggaatccaggctctctcccctgaaatgatacagacgattaaagtaatctgcaattgcttccaaagaagcaatatcttcctgtttctccgcaacctgctgtgccacagaaaccggaagccttaatgactgaggaatatgaagctcttccgcattttccagagtaaaaatggtggtcacacaatcttctttcgctctctttccctctctgttgcatcttcctgctgcctgtatcatagaatccactccggccatttcccgaaatacggtcggaaaatcaaagtccactccggcttctacaaggcttgtagctataagtctgcagggaagtcccattttcagcctgtttctaatctcagccaatacctttttacgatgcctgggatacataaatgtcgacagatgataggtcccctccaactcctttatttcattaaatatctgttgaactttttttctgctgttaagaatacaaagtacctgtacttgttcttttaactgatttaccagaaattcttctgttatttctcctgcatttctgaaaaccgtccgtctgaaaaaagcatattgctcctgtatttcaggacatatctccatcgcttccagctggggaggaaaaaaagattgcagggagggctgcgttgcagtacaaagcacagccgtactgtgataattgtagacaagctcactgattgcctgaatgcatggttttaaataatttacgggcagcatctgcgcttcatcaaaaataattacactgtttgttatattatgcagcttcctgcatttggaggttttattggaaaataaagattcaaagaactggacatttgtagttaccacgacaggacaatcccagttttcagaagcgagctgtattttattcagtttgtccggatcctcatacactacattgcaatgatcctcaagaacgttgttttcccccaggatatctttaaacacctgtgcattttgttcgataatactcgtgtatggaattacgtaaataattctgtccagatgatgttctgccgcatgctgaagagcaaaggcaagagaggatattgtttttcctccgccggtaggaaccgtgagccggaaaataccctgcttctcttttcctttttccagacaagctttaagtatctgtgtccttcttccatttacagtggatatatcgccactatcaagccatggctccacatgatgaaacaggcggtcgaataatgtttctatggaatcgaaagctcctcttttgattgttccgtcagtcataaatttttctgtatccagataatccgcatccacaagacaggaaaataaaatgcgaataaaaaaagacagactaaatccgccttttccaagctgttttagtggaggcggaggaaatacaggaatcttaacttcctttcggaattcctgataatcatcggtttgtttccgcattctgcccattaatgtggcttcgcctcccacgtcggccgcacttcctccatctaaaagtccggtatgatgccctgatatacaatatgcgcagacataattatgtctttgatataattccctggcacctgcagtggcatggtccgtcagctttcccccatgaatacgcttctgaaaactatcggaatatttgccgatatcatgcatcatgccgcagccatatccccaagcttcagatccaaatgcagaggcaaattcacctgctaattcagcagtcccctccagatgctcaagaatactttgttcacgaagcttatcttcactgatatgagctaagaacataatgtttctccaaaagtgtgatgttttttgtttattttatcttgctaattgtagcttgaaatatattttttgtttataattactatttttatgtagatgttggaaatattttttgatacttgacacggtaaaggcttcgagcagtatgtgaactctatggatattaatctaattcaatccatgaagttgcatccgattcgacaaagaccgcctggcccccgatgccttgatcatgtttatttcaatccacgaagccgcataggcttcgaccttcagtaggaacaatttcctttataattccgaatttcaatccacgaagccgcataggcttcgaccggcattcgtcacttccgctgcttgcatgcagggaatttcaatccacgaagccgcataggcttcgacgttgaaccgaacggattattacggatggacaaaagaatttcaatccacgaagccgcataggcttcgaccttgaaattgtaccgggatatcccccgcaaaatgatttcaatccacgaagccgcataggcttcgacatacggcgctatcagcagcgcacagagttggtggatttcaatccacgaagccgtataggcttcgacagcaaaaatatcgaaaaaaagcctcattatacaaaataaattatatactaattatatttttctccttacaatatctttattctatttatttttaatctcttcaccattaatacaactctttttcaggtgcgaatctcccgggattctcatgtacacttcctattcgcaccaacataactttattcaaaacaacatcatatcaatttaaaaccttatattttttatacctgagccataaccactcgaaatcctgttttataaattagagtatagcacaaattttttaaaatgataaccacctttcttctctaatccataatttatccacagttcatttcttcggtttttataggattaacttattatcacccaattcgccctgtaattaaaaagctatcacttctaagttataactcatatttatatatctcacacatcctacctccttcattcaaacacgtttctatatatatccagccaagccgcttataatatccccctgcattctccgtattaagataaatctcataataacctaaatctttcgcaatttgttttataaaatcaatcattctctgcccgattccctcatttctatatggaatatcaacataaagacctccaagccaaggcgaataactctttccatagaaatcattgtcaataatggtaaccgttccgacacattttccatccgcaattgcaacaagacggattggtaatttcgttttattattattcaaaaaatttgaatgaaatgtttcatattttaaatcatcatcttccctatgaacaaactcatcatataaccatcgtgaaacattttctctatactcaggataatcgcatagatacccaattactatcataatattcctccaataagtaattatagcctcaccttatcataattaaattacatactaaatatagacattttttacccataccacccgcaaggtggtgtagatggtacctataatccagaactttaccccattctaatttcataacacgaagccgcaaaggcttcgactatgcctgtcaatggacgggtcgtattttctccatttcaatccacgaagccgcaaaggcttcgacaattgccggcgggtaggatatattatgccgggagatttcaatccacgaagccgcaaaggcttcgacttccgccaggcatcacattgactatctgactgccatatttcaatccacgaagccgcaaaggcttcgactagccatatccattggagatctattactatctgctatttcaatccacgaagccgcaaaggcttcgacagtttgatgagtcggtaattctggtcgtgccactatttcaatccacgaagccgcaaaggcttcgacacgctgtatttgaccttattcacaatctcttaatatttcaatccacgaagtcgcaaaggcttcgactatatttcgtaaattcttatgtaccacatctaaatttcaatccacgaagccgcaaaggcttcgacctatctctttgttaaactatcttccataatatgatttcaatccacgaagccgcaaaggcttcgacgattaaaaacgatttagatttagttacgtataaaatttcaatccacgaagccgcaaaggcttcgacacttaaggagcaagtcacgatccttatttgcctgatttcaatccacgaagccgcaaaggcttcgacaactattggagaggggataaatggggctgttcaatttcaatccacgaagccgcaaaggcttcgacatctcttgaaaacttttggtcgtatccgcatttatttcaatccacgaagccgcaaaggcttcgacaatctcagtacggttcccttcttcgtctatctgatttcaatccacgaagccgcaaaggcttcgacatggggcgccggggcaggaacgccggcctaaaaaatttcaatccacgaagccgcaaaggcttcgactttacgatgtggttagtattcaccaagtatttcgcatttcaatccacgaagccgcaaaggcttcgacgcaggattaccttttatcagtaatcatccattcaggatttcaatccacgaagccgcaaaggcttcgacgagtttttatatgccagtgctgtcagagtatctatttcaatccacgaagccgcaaaggcttcgacttgttgggatgcaaaaaacaggtatggtttgccaatttcaatccacgaagccgcaaaggcttcgacatgtatgccaccaatcaggcagatgcgtatgagatttcaatccacgaagccgcaaaggcttcgacatactagcaaggggtttgtggatggaatcaagcaatttcaatccacgaagccgcaaaggcttcgactaatagccctggtaagagcattggaacggattgagatttcaatccacgaagccgcaaaggcttcgacggaagagttcgcgactatcaccgcgcgcttaataaatttcaatccacgaagccgcaaaggcttcgacggattgcagggaagagttgcggccggcgaagaaatttcaatccacgaagccgcaaaggcttcgacaggagatactggcgccaccggtccacaaggtgcatttcaatccacgaagccgcaaaggcttcgacccggctatttttccttttgccttatccatcacgatttcaatccacgaagccgcaaaggcttcgacatattcgctgaatctccgtttagaggcgggatctatttcaatccacgaagccgcaaaggcttcgacagcaaaaacatccaaaaaacaatctcatttttaaaaacaatctatacacatattataatatccccactcacaataactacattttaatcattttcaatcttttcaccattaaatccaccatttttcaggtgcgaatctcccgggattttcatgtacacttcctattcgcaccaaataactcaattatcaaatatcaccattgaccaactattttctcaaatcccccattcatatcatcaaaaaacttaccttccaaaagcctcataccataaataaaagtatatcacatatttttcaaaatgataagaaactttcttctccatttcgtaaattactcaaatttcaatttttatttttaacactatccagttacccccttccccctcattcccctcaattcttcccaagaattatcttcctatttcatacacgcaagtgtataattaccatagataaataaattaaaaataactgttctgcaaaataaaatcaatcatatcatcatacacacaaactgaatgaggtacaaattatgtctgctgataatctgtccaacctgctgaatgcactgacagaaaccagtgtttacgttattgaagaaaccagccacaagctcttatattttaaccagcgctgccagaataccagccgcggcaaagcggtcctgggagcggaatgtcataaggtctggcccgaagtctgctcaaattgccctctggacggaatggggacaaactcttccaatcacatcgtctgttatgatccgcttttggaaaccacagtggatgttactgccaaccggattctctgggatggccatatcccggcggtagttgtcactgcgactccgcaccgcctgaattttgaagaagagcagggtctgcaaaaagttgagaggatgtatgctcaaagccttgtaacagtattcggtgagtgtgttatagccaatctgactgctgatacgtatgtaaactgccagaaggatatgatgtggactgatattccggagcggggaaaatttgcagcggaaaaccagagatatgctctccggactctgcatccggatgatttggataccttcaataaatatttctcacgggatgccctgctgtactattttggaaaggggaaaaaacaaatcacacggaagctgcgccgcataagcaatgacggcagctaccatatggtggagttcactgccgccaaaatcgaccctcttggagatgaagaatactggtgcgttctggtattccgggatgtccaggaagaatatatcctggaacagcagaaaaatgtggagatcagccagttagccacagccgccaaaatcgcatatcagatgctgctttcggtcaacctgacccaaaatacctttcatatgctggaatataaccgctatccgattaaaaatccgggagcacagggctgtttcgatacgctcattgaaaccgagcttaccaccgtacatccggattaccaggaagaatttatacggaaatattccagacaatctatgattgatgccttttccagaggcgagcgtattataagcatggaggttcctcatctcggagaagacggcatttaccattggaatttcacacaggcggttcaggttgtgagtccctatactgatgatctgattgaaattaccttatccagaaacattgatgaggatcgccgggtacaggaggaaactcttgaaaaagaacgccgttccaagcttcttctggaggacgccctgcaaaaggcggaaaaggccaatcaggcaaaaagtgattttctttcaaagatgagccatgatatccgtactcccatgaatgccgttatcggtatgacacaattagcccagcttcacctgaaggatgaagataaactgaaggattacctgcagaaaatcacgatttccggcacacatctgcttaaccttattaacgaagtactggacgtcagtaaaattgaaagcggtatgcttgaattggatgaacgtgaatttaacctgaacgatttggttcgggatgtggcagaaatgattcatctttctgttgaaaacagacggcagaaattttcccttattattgacgacagccttcatgcccaggttctgggggataagcagcggctggagcagatactggtcaacattctggacaacgcttccaagtataccggcgaagaaggaaacatttccttttccctggaagagctgaaaaagaatgagcagcatgtaggcacctatcgtttcacggtagaggatacgggtataggaatgaaaccggaatatatttcccatatttttgaacccttcagccgtgctgatgacagccgtaccagcaaaataaccggaaccggccttggaatgaccattgtaaaaaatcttatctctatgatgaatggcgatcttcaggtagaaagtgaatatggaacgggttcccgttttgtcatcaccatctgtcttacgaaatgcgggacacctgccgtatccccgccggaaaaacatcccacggaagaaaacttcccaacactgcgggcccttctggccgaagacaatgaattgaacaggcagatagctacggaaatgctggaaattcttcatgtccgggtagaaaccgcagaaaacggacgggaggctgtaaatgctgttttatcccatccgcctctctattatgatattatttttatggatatccagatgcccatattaaatggctatgatgccgccagggaaatccgggcctccggaaaggaaaggatagatgaactgccaatcatagctatgacagccgatgcgtttgccgaagacgtcaagcatgcaggactttcaggaatgaacggccatctggccaaacccatttccattgaacgcttaagggaagctctctccaactgtctttcgtggaaattgcacaatcaggggagttctccttcctgtgatgaattttaaggaaaaaacgatacctgattataaatatgagtaaaaccaagaaggtaaatgaccatacatccacagtcatttaccttcttttcaaatccatttctgcaaaacctccagcagacggtttatttccagaggcttcgccacgtggtcgttcatcccgacactgcgtgccttagccacatctgccgcaaaagcatccgccgtaagggcaataatgggtatctcctgcgcatcctttctgttcagagcccgtatttcagaagcagcatcataaccgtttaaaaccggcatctgaatatccatcaatattgctatgtaatcccccggtgccgatgcttcaaagacttccttcgccttcttcccgtcttccacagctgttacttccattccctgcatttcaagcagctccaccgcaatttcacggttaatctcgttatcttccgctaaaagaatccgtccgccgcataatttactattctcagccctctttgccggttcttttttatccctttcactcacagacagcactgacagctccgcaggttcagtgtttccggcctcctcccccatgcacacctccagaggtatcgaaaccgtaaatttacttccttttcccagttcactttccacagtaattgtcccattcatcatacggacaatattttcggtgatagccattcccaggccagtcccctgaaccttactgatacggggatcttcagcccttgaaaaaggttcaaagacagatgggataaattcgcgggaaattccaatgccgttatccgcgcagataaattcatactggcttttcccaaaaacagaagaattcagttcattgaccctcagttcaataattccatccgcctgtgtatattttatggcattcgacaatatattcatcagaatctgcctgagacgttcgccgtccgccttcacattttcatgacggatctgtgcgatactgagcttaaaatgctgctgtttttctgtcataagcggctggcacatatccagcacgttctgcatcagttccggcaggctgagctgctgcggcatcagggcaatcttgccgctttcgattctcgacatatccaggacttcattgatcaggccgagaagatgcctgcttgaagtatctattttatccagacaatcttttattttttccggagagttgatattcgcctgtgcgatagcggacattcccataatagcattcataggcgtacggatgtcatgagacatggatgacagaaaattggttttggcagagctcgccacccgcgcggcctgataggcttcttccagcgccttacgctgcctcgccttctcttccctttcctctgtcacatcgatacccacactgtaaaatgattcgataccatcccagctgtcttcactgcccacatagctcagcgtaaccatcaaaatctttatttttccggcgcgggtaacaatacgggcttctataacggcatcctttcccgtctctttcgcccctctcatcacctgcagcgcgcgggggatatcttccggatacacataggccatctgagaatgaagctcctctttaaactgctgctccgtgtagcctataatatcaaggaaatccccgccaaaccaaagaattgtccccatatcccgcgcatccaccctcaccagcccgccgggaacagaacgcagaatggcttcccgatccagttcctttttggcaagcttaaattccaggctgtagttgtcatgggacatttcaagacgggccttacgcccttcccagtcaacaatacgatccttaatcatgtatgtccgctctaaaaacgggttatggaactcccattcatagaattcgtcctcactcagatatttattggtacaaaaaggacacggcgaagtcctcccctgtatgatctcatagcatttatgtcccagcacttcatctaacgtaagccccagcgtatcgcaggaagtcttgtttacaaataaaagttcataggtttccatatccgcaacataaacattgtccatgtactcatccaaaacccatttgaaatactgagcccgtttcttccagcagcggcattcctcctgcctggtcatgcttcctgtactgttatccgtataaaccgcatgacatatccaatagccatccccgtttttttccgtcagtgtcaacgaaatattgacccacgaaaaaccgccgcttttccgcggcatacgaacattcagcgctgtatccgccccgccattttccgcagaatataccagcctgtcccttatagcttcccaatcctccgggtactcccggtagtatcctcgcatcgtttggaaacaagtctgaaactcttttttcgaataacccgttttctcataaaaagaattactggcttccagaacagtcaaatcatcatcaagcaaaaagcatatggctgatatcttcagaacgttcagaatagagccatacctgccgctttcctgctctttttccgatggaactgccagttgttccgtatttcgattgtccatatccattctccttaattgagataaacttcaccagccagcgcttccatgctcatattatatctgaacaatatagtatacgcaactctttccgcttccggttgatttattcataaaaggctgccgtgcagcaagtacacagcgcgatccggacaaaagcagggcttccctcaataaaactcagcttcatgctttttaaagaaatcataataagcacgtacatttccaagctgtgtccagcgtttcacatccacaggctcctcatccatatcataaattttcgcattttgaatggacaaaaggaaaggcgaatgtgtagcgataaggaactgacatccgtaaaagcgcgcggaatcctccagaaaccgtaccagctcctgctgcttttccggcgacagactgttttccggttcatccagcagataaagcccgttttcctttattttctcagaaaaataaagaaaggcgctttctccattggaatgctccctcacatttcccatcaattgtttccgcacataacgggactgggtcttgcttcgcgtcatgttaacctttttcagctgctcataatcctccagtgaattcatccggaagctggaatatttcgtttccagataatcttcaaaaagttcttcccttttccgatcgatcccgtcgttgatattgcgcagattcagaataaaatcaaagacatcatcactggtgatgatcctactgtcatcagtgagcggctgttccagctcacaggaacacatatctgtataatcttcaaagaaattggtacggttatatcgggtgtccctgtgaagcttcagtttttccgcaatcacattcagtacggttgtctttcccgatccatttcccccatacagaatcgtaacaggctcaaagtccagcatggataactggtgcctggaaagaatttgaaaggggtaataggtatcatagcaggttcttttctgggacagaagaaaatcatattccctttccacatgcgggaacgaaaagtgcgacagatagatcatagctcattactcctgacataattacgacatttattttgctataaataaatatttttaggaaaacgaaacccttcaggctgtgtaaacttatcttacatcagtttgaagggtttctcaatctctcatttcataaagcctttttcgaaaggacaaaaccttatacaattttatggatagcctcaacggacagaccatagttcagcgccaattcttcaactgtgaatccctcccggtacttttcccggatttcttcattccgctgtttataatatgtccgggcgccggaaacctctccccatgattttttcgtatctgcactgggaacatagaggacaccgcctgaaatatattgctgcagttccctcagtaatttatccgggagaatatcctgtgcatttttatacttcatttaaaaactcctcaaaattttggtattcccgtattttcccgccgccttccgtaattattttccgcatttcctgttccaggctgtctgcatacccggcaaatttctcaagccgtgaaatgtcaaactctttcatgagttccatcttagggattccgaaatcgtaacagacgcgattcaattcttcctgcagcatgatcccccacatataagcctttgtgctgtctcccgctttgcagtaacagcggattctgagccatgtgtaggacagctcacaataccagtctgccaaatcctgaaaattcttttcctgcggcttaaggacctccggcctctctaaaaagtcctgtaccagatgaatcagttcataacattgtttcttctgggtttcttcttctttttcccgtatcaccgccagataccccgaggcaaattgctccggcacatattccatccgggaaagttcctcaagctgctccgcctgggcttctttgaaataccggcaattggaaaaagcgattgcctgggcggtataatccagaacgtaacccgccccaagcttcacatcactgcctttggaaaacagcatattcagataaatctgttttgcctgctctaatgcctgcagagcatgtgcccgcatcaaaaccggattggaaagattctccacctggcgtttctttaaattttcaaacagctctctgtcctcaggcgttctcgcatagagtacctgcgaatccgccaggcaggagatattatactcattcaaatcggcgaattgctccatccgctcccattcaattccccagagatctattccgacgccgtctaaaataaatgtgcgggcgaaccggcggcctttgtctgtaattgggataaaataacttactgagggagttcccttttctgattccaggcgaagggtattgtgggaaactaccagtgcgatgtcatccttgtattcctcttccaccttttccagtacccattttgtaattaattctttattattcattctgtttttctctccttcttgttcttcggttaaccttaggttcattatagcaacagaaggactgacgaaaaaggttgtaaatgttttatactgttttttccacatcagcatcgttctcaaatgattcaaaaaatgatatatcggaaatattctttagttctttcggccccggctcctctttcggataacctaccggcattaaaaacaaacaggctatattttcaggcaatgcaagaatatttcccgctttctttatatcaagccagccaacaaaacaagcggacaacccatgtgaaaccgccgtaaggaatatgtgttctgccggtatcagcgggacagaattcgcaagaagcatgtctatttttcatttaattgtcataagtaattattaatatcttctgtcaaaaactgctctccgcagcgtttaatttctcctaaaactctgctgattccgccttcagataaataccaattatttttatcgatattatatgcattacagggaatgaccaaaaattccactcccggaaaataagactgataaaacatgaggcaccttcttgcatgaaatgctttacatatcaataatacctttttaagttccaacccggcatccacagacagcttttttgcataaacagcattctctcttgtaaatgccgatttcttttccccaagaatcacatcctccggaatgccgtttttcagtaaaacatctgtataaaaatcacattctgtcaggtattctttattatagatttcttttttagttctcggtccctgaaacttctttaaccctgcaccgataccaccgcctactaatatgaagggagcataattatctttccataactgcgcggctgtctctgctaattcaggaaaacctccccctactaccataattgcatctgctttttccggtacattttctacaaatacgaaattactgatatcttcaatgatatgattcacattattctcctcagccttagctcaattatcttctcccgcgcccctgctttgcgcaaatatcagaataattacctgcgtacttatttattatatcatgagtcctgccaccacacatatccagttcatcggtttattctattcccacaaaggtttttatgtttatttatgcatttgccttccaatgccccaacccgattttcaatacctattgaccatagagtaattatacagtaaaattccaattagtcgttactaactttcatcaaaataagaggtaaacactatgcaccacacaaatcaggcactgaatgaattataccaaaatttgctcataaacgctccacaaaccgtatctgtggaaattcctccggatctgggtaccggacagatcacgcaaacagaaacaaaacagggaatcgttctgtccgactggcgcatgaactatctttccgacatgaatgtgcaggggacaaacagtcctgaatacatacaaattattttctgtgtaggtgagggaatttcatggggaacaacgaatgaacgttattccgtcaatatacaaaaaggggaatcctgcatttataacgggtgcggtaaaacagagagcatctgttacagccaaaaacggggtttttactttaaaagtttaaaaatccctatgcggtatttttcatcactcctgtctgattattttgataataaggaattgcaaagctgtgaaaaaaagttgttcaccggattttccaaagtgaaaatcaccccatccatggaacgcatccttgcggaaaccagggattttgctcattaccatggaggactgggacacctgtatcttgacggcagaatatctgaactgctggcagtttatttaagtgaagtcctggaaatggacatgctctcaaataataatgccctcatatctgccacagaccgcgcatcccttatggaagcaaaacgcattattgacagccagatcgcctttgcaccatcctgccaggagctgtcccggcttgtgcacctgagcgtaacaaagctcacaaaaggcttttcccaaatattcggtatgccggttcacacctacatcattgaccggcgcctttcctgtgccgcacggctgctgctggaaagcgacctgaatatcagcgaaattgccatggccgtgggctacgcaaaaccaagtaattttgcagccgccttccgaaaaaagtatggtgttgttccgaaaggctacagaaaatcacaaatccttgactcctgattatttgtaaaacaaaacctttttggggcagaaaaaaaatgattttgggttggatcggtttgataaaactgttaatgtatgcgatgtggttaggcctttctaactacatcgcattttaatttccgtatattatgaggaggaaagactatgtccaaaaaattaaacgcaaaagattttatccttataggtgttctaaccgcccttatgtggatcatctgcatgattatcagcactatcatgagtgtagccggccctgtcaccaatgtattctatccggctgttgtcgctgtccccaacggaatcgtcatgatgctgctcctggcaaaagtgcccaaaaaagggggcttcacaatctgcggcacgatacagggtatcttattcctgctggtaggcgcgttctggtttattcccatttccctgattgccggcggacttatctgtgacttccttgttatgagacgtaaagagctctctctcaaatctatgatcactgcctattcccttttcagcggaattttcgcattcggcgcgatctgccccatcaaattactgcaaagttcttttgttggtgccatggaaaaaaataatattgcccgggattatattgatcagatggtacgcatcacctctgttcccatgctggtcttaattgtggcagccggattcgcaggcggtctgctcggcggttacatagggcgaaaagcattgaagaagcattttatcaaagccgggcttgtttctgtaaaataagcagtatacgttgttttctatcaaccatacaggcatttgccggccggctgcctgatatttcagaacggggctgtcgacaaacggctccgtttattttggagatttcatatgaaagaagaacatatcaaacagttaattactgcaaacccttttcatggtaccgcctgtttggatccccgctgtaagggaatcctgctgatactaatcggcttttccagctatttttcaggtggtgaagctgtcagctttgcactgatgcttatttctgcaatttttatcagtttcggcaacggtatgggatgggccgccaaaatgctcacggcatacgttattacggcatatcttaatgcgctgctccgttatatatcgatccctgtattcagcgtaattatgagtgtattcggcgtaactctgcttaaattaattcccattgcaatgatgggctgctgggtcctgaaaaccacatacatggatgaccttatggtatcgtttcaaagaattcatcttccccagtcagttacgatcccactgattgtcatgttccgctttattccgactctgcggattgaatatggcatgatccgtgacaccatgaaaatccgggggatttgtgatactctccgtgaaaaaataactcaccccttatccacggtcgaatatattctgattccgctgctcatgcgctgcctgaaagtaaccgacgaactggccgcttccggcaccacccgcgggctggagctggaagaaaaacgctatgccctcaatccagtctccttttccccgcttgaatggagcgtcacgatttcctgggctttttttctgtccgctctcctgcttctcgggcagacaaccttaggaaatatcatactatggagggtatgaaccatgataacattcaataacttttcctttcgatacgaagaaagtccatattatacgctgaagaatataaatatgactgttcagacaggagaattcatcctgctgacgggacgcagcggctgcggaaaaacaacattaatccgctctttaaacggccttatcccccacttttatcctggagaaatcaaaggctcccttcttttggatgggaaatccatcccggagatggagccgtcaaagcttgccggacaggttggtactgtatttcaggacccacgctcccagttttttatgactgacaccacacgggaacttgccttcggctgtgaaaacatgggtttctcaagagaagaaaacattacacgtattgtaaaatctgttaacgatctggatttggaggaatatctgaaccgaagcatctttgaattatccagcggtgaaaaacaacagattgcgattggatccgtttatgccctggcccccaaagtctatatttttgatgaaccctccgcaaatctggactatcaggccgccaaacggctgtccggaaccatgaaaaaactaaagcaggaaggatacactatctttgtcgcggagcatagattttactatctccgtgatttattcgacagggcctttctgcttcatgatggaaaaatcgaacagtgctttaccggagaagaattttgtattcttcctgaaaaaacacgcatcaaatacggcttacggactgcctatccggaacaatctgccggtaacatccggacgaaaaaaacagaatgcagacgctctgatacactgacagccgaaggaattttcttttcttataaaaagaaggatgaaattctgcataacatcaattttgaagcacattccggagaagtcattggtattctgggccataacggtgcgggaaaaacaactctcctctctcttttgaccggcctgctgaaagaaaaacacggaaagactttgtataatggaaagaaccttactccccgccgccgtcgtatcctatcctacctggtcatgcaggacgccgattatcagcttttcggaagcagtgtggatgaagaactgtcgcttggccttaaaaatgactgcactcaaaagattgtcggaatattggatgcactgaacctttccgcatatcgggaccggcacccggcttcgctttccggcggacagaagcagcgtgttacaataggcgcggccatcgttaaagatagttccatcatctgctttgatgaacccacaagcggcctcgactacgattctatgctgcgggtcagcgaaacgatcgaaacacttgccgacgacggtgccattatttttgttgtatctcatgattttgagtttatagcccgtacatgcactgaaatcctgctgcttgataaaaaggacacggtacaaaagacacatatgacaagggaaatcctgcaggtattggcaggtaaatattttaactgatatagggtactgatttgccagaagaacagtggctcagattcctaaatcccgtttcagagcatttataaacagacatagacagattatattcattttaatccttcttgcgttttcagcttgctcacatcgaacatatgtgctaatataatctgaacaagtgttcgatctatgaagggggaaattgaatatgaaggagcataaagccaaccgggaatttataggctttacccttatatccggattgatttcattcggatataatgtagttatgaccgttatttcgctcaggatggtggatcacgggctcagctacagcaagataggaagtgccatgtctgctgttgcaataggcctaatgatcattaaacttttgattgggcatctttccgatatgctcggaaccaaaaattttatcctctctgctctcgccgggcttgggatcgtatgtgttcttctggctaaagccgacaggctattggcctttaccgtattaatggctgcactgggtatctttcgggggatattccttgcggtaagcggttcctatgtaatggaaatggcaaacagcggagaatatgggaaaatatacggagccgtacaggggatatcctccctgctggccagtgtaggcggaatgatatccggtctgctgtatcaattcaaagaaggggaatatgctctttacatatgcagttttctgctgatagcatctactctctgggccgccataggtctgaagaataaccaatgtatgcatggtgaacggcttcccatattgcagattttcaaatccattaataaaagaatactgattttctgtgtattggtttttatccagtccttcgtagcagggcccatgtggagttttatcatacccatgtactgctacaatatactgttcttttctccagctaaattaggaatacttatgtcgatggatgaactgataggcgcacccacttatatgctggcaggccgtgtggtagacaaagtaaatgtggtgaaattcaatattcttttccttctgatcactgcattaggcggactgtttctcataaaatcccctacaccgactatatttatggttgtattccttatatgcagtgtatctatatcctgtacctttgtgggtattcccaaagaaagaatcggctttatccgaaaggaacaaaaaggatttgagcttgcgctcatatctgtctgcggaagcctgggtgattctcttgggaataatgtactgggcagagttgcagagaaatacaccattgatcagtgtatgtatatcttctctgcatcctatatagttatggcacttctggttgccttgcctcttttattttccaatttccgttttgcatcagggaaacaggaacaataaaagggctgcactcgcatgcggccccattttaatgcctctgtaggataattcatttttatttaatcagggctttcgggtcagatataatgcaattgtgtcatccagaatgattctgtttcccgcatggataactgcttctctgactccattgttgaaattcgacttatacggctcctgtaatgttatatgctccacctgcgtgccggacagatattccacatattcatctgcattatatattctggtctttttccagtcccggtaattcaaatcaacaaatccgtagttaacaacattatcgtaattcaagctgcatgtgtattttgtttccacatgaaaatgttcatcatataccttttgtatttcatcatataatgagccattcgatgtcttttcatccgtataggtcataaacatggctaatgctccgccattcttcagaagattaaaaaccttgggaaaaccgatctcttccggtatccactggatcgtagccgcagaaaagaccaaatcaaatttgcgttcaccgaaatcatgagtttcaaagtcatcatttacgatatggaaattttcataggtaccgaatttcttttttgtaaagtccacaaaatgctcgcccagttcgattgccagataatcgcagcccgtctttaagaacggttccgtagcctgccctgttccgggtccgatttcaagcaccgatttgcccgggccgatattggcatattcgatgatatccctgaaaagttcgtcgcaatagcgcggcctccacttatcaaactggtccggtatcctgtcaaacgtttttctgaaatccattgctttcgccctccctgattttatttaatacatttataaagtgtggtctttgaccattccctttctataaaaacagctgataattctgcgaattatttatatcatactatagatcatgttaaaaatatatacatttgttttatgtatgaaaaagtaatatagccatatatttttaaacatgatataatttgagcaatctaacataggagtcgattccaatatgaatgtagaatacagaaaagcaacccccgaagatcttgaacagatatgggatatgaatatcgctgataacaacggcaatgagcgctggcgtatgtggaaggatacatatatttcctataatcaaaacggcgatgcatatacctttgtcatcctctgtgacggcaggccggtcggtgagggaacccttattttttcacctgaatgcggagcagtcagcggaagaactgagcttgccgacactaaaaccacggcaaacgtaaatgcacttcgcatccgtaaggaatacgaaggaaggggatatatatcagcccttgtgcatatgatggaaagctatgctgcccaaaatggctataagtacctcactataggcgtggaggctcgtgaaacaagaaatctggccatctatctgcattggggatatgataaatttgttatgtctgaaattctggaagagcagctggttctgtattatcgaaaagctttgaataaataagacacttgcaggaaaaagccggctgaacttatccataagtgtaaacttttatacactaatgaataggctcgccggacctctttctataaaatgttattttctgttttttatttcttcactgctaaactattcagttctttcagcacttccagtatctcaggtctcactacctgattattcatatctacaagttcaaaatccagacatttataattccacatagcatggcctattttcaggctgttgcaaatagttatgaaatcccggatccatttaacagcctcttcctccggtgcagaatcaattactccgaattccccgcagtatagttcacggccggaatattccataaatttctctgcgtctgaaagaagtttctgcatcagttttttatcattacagactgtatcttttgacatcaaaggatgttcctttttgaattctttatgtgtatccagaaaagtaatatagtccgtcatatcaccaggataagcaagtgtctgattccatgtgcaaaattcctcggaaaaatgtgctttctgatgggtaaatacattaggttcataataatggaaattgtaaaacacataagggtcttccagcagatcaagacgatcaagatatcccacactattaacaaaattcgtacccaccaatatccagcgttcagaatctgccttacggatctctttgacagcctgtttatatagtttattccacatgtatccggtggaatccgtaatttcattaaacatttcaaacataagccttgttttatgataacctttaaaatgctccgccatatttccccaaaacctgcagaaatcatccctaagctccggttctgtcataagaggcgtagggctgtccatttctccaaagatatgtcctcttatattatgcagatcaattaccgcattcaaaccatacactgcacaccaatccacacagcgatccaggtattccaaaggttcatcttttagaagctttttttctgtatcaaaaaacaaatatccgtccaacgggattctgacatgatcaaatccccaggaagcaattcgtcttatatcatcttctgtgataaatgtctcaaaatgactatgcagtgattcttctgaccctgcatccgctattaattcgtattgtgacagaaaccctcccagattaatgccttgtttaaagctttcaaacagcataaatatatcctcctctgcttgtttttatttttcatccttttactgctcccaccacaataccgccggaaagatatttggaaataaacgggaaaattatcaatacagggattgctcccagaacagcaatagccattttcagtgtcgcagtcggcatggacgcgccgatactgttattaatcgtctttgacagcccctgctgcatatacagagtatccagcagcatccggttcagcagtacctgtattgtataccttttatcattgcttatataatacagaccattctgccagtcattccaataattcagagatacgaacaggccaagagttgccaggatgggtttggacatcggcagcacaatatcccgcagtatacggaattccccggcaccatctatttttgctgattccagtaatgccacaggtatattggaggcaaaaaagttcctggccatgataacataaaaaccattcactaaaagattaggaaggatataagccagatatgaatttttaatatgaaatgtatttgtccacatcatataagtgggtataagtccgccattaaacaggattgtaaagaacaggaaaaaggaaaagaaagtacgcccttttaaatctccccgggaaattggatatgcataaagaatagtaaggagaagatttcccaatgttcctgtaatagtaattacagcagaaatgccataggaacgtaaaatcccgcttgagccatttataatatatttataagctgtcaaatcaaattcccttggcagaatgtgatacccttcatgaagaattgctgtttcattgctgaaagaagatgaaaacagcagtattaacggcagtatacaaaacaatgccaataaaaataatataatatgatcggttatctgaaatactttatctctttttaccattttaacctctccgaaaaaacacagtatttttctgaaactcagaaaatggcactgtccttgtcaatttttctcacaatgccgttagccactaatatcaatataaaaccaacaacagattggtacaggcctgctgccgacgacatgcctaaggtgcccacgcttttaattcccctgtaaacatatgtatctattgtatttgtcacattcatcagtgcactgctgtccatcggcacctgataaaacagaccgaaatccgaacggaatatgcttcccaactgcaaaagggtcattgtaatgatagtagaccgtattaacgggacagttatgtatctgattcgctgaaatctcgtcgcaccatctatagttgccgcttcataatagcttgaatcgatacctatgacagatgaataataaattatggaattatatccaagccatttccactgattcacagctaccagaataaatggccagtaattgggccgggcataccaggaaattcctttcttccctaatggtataagaatactgttatttataaatccggtatctgtactcaacagcgcatagacaatataactcaccacagttatggatatcatataaggaataagatatgtcatctgataaaggcgtttcccctttttagagctgagttcatccagcaaaatagcaacagctaaccccataaacaaactgacagcaataaaaatcagattatagcccactgtattacgcagtataatccaggaatctcttgtagaaaaaagagacttgaaattatccagaccaataaaatcacttccccatatacctttctgaaaattaaattttttaaaggcaatcacagtaaatgtcattggtatatagttattaaacagcagataaacaaaccctggtatcagcatacaatataatgccaaattcaaatgaatcctttttttcttttttttcatacttactccatttacattcacaataaatattctgtatctggcattacgtcatacctaccaaaacatagtgccgtaataccagatactaaatatatggattatttattatcagctaaccagttatccaactgtttttgcttttccgtcaggattttttgaatacccgcttcctcaaactcctgtttcatctgttcccacacagtgtcaggatccacatctcctgtctccagcccttttttatatttatttagtactgttgtacatgccactacctcattggttacatccatactgtcccatacaaatcctttagcagtcgacggctggcagtctttattgaactgaatggtatccgcccatatatcaggaccatccgtaacccacttatgtgcaattaactcattggggaaatgccatgcagcaacagtccagccaagatcatcggaggtcactccttccggataaccaataacaccattttcttcatctacgaattcatagtacttaccttcgataccataaatgagaagattagccacatccggattggaatacatttcgtttaaaatctgcattgctctttccggttgttcactggtataaggaatataccaataattattcagattacttgttgttgtataatatggaacaatattgattatagttatatctattcctgtatttctttcccattgagattctatgccgggtttcgtttcagtagttgcacaaaaagcttttcctgctccgacaagacttgtaacctgttccgtattgatgcttgcatcaggcataatcagcccattttgggaccattcatgtctgcgtttacacagttcatagtattcgtccgatgtaaaaaaattgactacagtagtatcatcgctgaatgaatctattaatacaccgaagtcccttcccagccagtctattgcatacatataatcacccatagaaccactgtcggaagcaagagggtatacatccggatatttttcttttactgcctgaagaataggttccatatcagcttctgtcataatattactgtaatcaatgccaagagattccagcatttctgtattacatgcaaacccaagccccagtcccaattctttattattacggactgcataaacctgtccatcgatagatgttgaagccaaatcctcagcactgatatctgcaaggatatcctgcccgtctgattccagcagttcattcagtgcaataacctgcccctggcttgcagcactggggattggaatttgagagacacctcccagcaaatcaattttttcaccggaagccaactctgtctgtactttatccacataggttgcaaaatcataacgtacaatttcaacctccgtattaaacttcgcttttgtaatctccgaaacagccgccccgatttccgcacaggcttcttccgaaccaaaaccatccgctacaattcttaccgtataaggctcctgccctgataaatctgtttcttctgcctgttcccctgaatccccggcactttcttccccaatctgtgcttccgaactctctccggccatactgctttccaccggattcttctctgctgaaccacagcctgccataagcccggccagcattgccgctgtcaataagatactaatctttttccgtaacataattccctccttggttttttgtgcgatttattttacaactaaagtgtaataaaaaagccggctttgtctcaacaacaaaaccgaccaaagactagaacaatttcgacttttgctttacctggaatctatactgttataatattcattgggggtcatattcgtccattttttaaataccttcgcaaaataggaaggcgtatcaaaccccaccttagtccccgcctctgtaatcgtacacttctgttctgccagaagacgcttggaaaccagtatccggtaatattggatatattgaaccagtgaatagccggttgcttttttaaaaatacggtttagataatcaccgttcagatggacggaggactcaatatcctgtctgctgatatcttccgcataatgctcatgaacataatccttaacattttctacaacggcccatgcggacggatgctgctccccgttttccgtgtccattaccgattcaatcaaatcatctacatcgtatatgaactgccccacattccgatactgcatggctgcatgttttaagtccttcgatcgttccgataatgtttccagactgatatgatagataaaatatgcgaaaatctctcccggaaaccgatccttcagttttgacataaataattcgcacatttcgtacagctgagttctgtcatgttccgtttttacgatccagaatatattatcccacaaatgcacttctgttatttcgggaaaaagttcttctgcaatattgcttaacgcaaacaataaaatgctgttatttttcatttctacctgagcacccgcaaggcggatgtataccagacccttcggctccagttcctctctgttaagacatcccatcttcagagctttgtcaataaattccggaaagggcagaatatctccggtaagcagattggtataaaatatcttttcttctcttttaggttcctgctgccggccggaggatatctgaagcttttcatttttccttttattaatttcatcagcggcgagcctgacagtctccgaaagttcttcaaaaccgacaggctttaataagtattttacaacgccaatattgatagcatcctgggcatatttaaaatccggatatcccgtcaaaataatcttcacgatatcaggaaaggattctctcacccatgccagaaaaaaaagtccgttttcctgaggcatttcaatatcacagacaataatatctatcttatttccggatacaatctctctggcatccatcgccgtataagcagtaaatacttcatccatacccaggctctgccagtcgatatgttttttcagcaggttaaccactatcacttcatcgtcaacaattaatatattcatagctctgcattttcatccttcctgaacctcggaatactgatatcaacgcggcaacctttcgattcattttgtattacgacttcagcatgcctcgggtacagtacctgaaggcggtttttcacattgacaattccgatatggctgccatcctcttcaatatcttcatcccggctcagcctgtccagtatttccccggggaatccaagaccattatctttaactgtgatatggagcagatcttctgattcttcaatcatcaaggtaatttccaaatcatgcaccagcataatattgtgcttgatactgttttcaacaaaggtttggatcaggagcggcggtattttttccatatctgcatccacgttacaagttattttcagctggaaattatcctgatatctgattttttgcacctgcgcatatcgggctatgcactgcagttcatcctccagatatacaaaatcatcctttaaggataacaggtaccggaaatactctgccatcttttttgtaagatcctttatcgtactataatccttaatacttgccagcgtgtaaatcaaattcaatatgttggtataaaaatgaggctgtatctgtacccgtaaaaactgattatatatcttttctttttcaagacttgtcttatatacatcgattttcaaattgataatctgttccgccatatggttgaaggtattatataaaacggttatttcatgatttgatgtgcgatccttcagtctgacttccgtgttgccgccgctgaattcttccattgcatttttaagcttggtcaaaggcctgaaaaccgattgctgctgataaaataatgcaatacatattaaaagaatggaagcaataattgcgataataatgatgataaacagataagaaccgctgctgacgaaattgacatgaggtatttcaatacatattttcttattaatcatccttattgcccttgaaaaaacgaaacaatttttatactctatcgctacattcggctcatagaacactgagccatccatgtttaaaaggtaaacattactttcctgatcctgaggcatgatatcccgcagaacattttcacagctgatgtaacagcctccgaatcctcccttacgctcatagagatgaaggaaataataattgtctcccaatctgatatccttccattctgctgaattattaacttgtgtatttaaaatgtatctttttaattcttcattttcttcttcctgaaaataatccagataggaaatagaagaaagcatgatatccttatccggtataaagacaaaataaacgatctgattatcattgaggatagacagattggttaaatccctctgcaaatcggaacttctttctgcaatcactgcagcatcctcagaatcacagatcaggttataatccgtattgtcatttttattgatcagggaagtcagctctctgttagccacataaaattgatccgcccaataattactggaataattcagtgaatttttataaatctcttcgattctctgattgaaacgtttgatagtaaaaatattgaatactgcaaataaaaagactacgaaaaaagaagttaacaagatgaaatatcccgattgcataaactgcagttttttcattttacacccgattccttatcactgaaagttcttacctggcatgttatgtaatattggttacaatctatataccagtagtagcatatcttcattataacataaaaacaggtcctgacaatgtaacttgccgattgttatgacatatctgatctcctgatatttttatccgacaatctgtaaaaggcaataaataacggcccctgccatggcagagggccgcactatataaatcaacactatatgaattaaccgtactttcatcggaaatatcttctacttatcaaaccacgaatgtccatatcccgcaaggagttgttcggcttctttcggtccgctgcatccctgttcataggaaaagacgggctgtccgtttcgtcggtacgcatccttcaatgcatccacatatttccagcttaaccccacctgatcccactgggaaaaccaggaaagttctcctttaaagcaggcccctatcagtctttcataggcttccggggtattcagatggtgttccacggaacagctctggcagaagtccatttttgcctgaatgatttcctccgtttctcccggtctcttgatattgaactgcagatatactccttccgtaggctgtatcctgatgttcaggatattggattccgcctccggtgacgggcttttgaacacaatcgccacctgcatttcccttttttcgagcttcttaccggttcggatataaaaaggcattcccttccatctttcattatccaccaaaaggcgtactgccgcataggtttcggtatgggaatccgccgctacagaaggctccccgcggtagccttcatactggcccagaaccatactgccggaaatatcctccggcataaccagcgccgcaagcaccttcatctgttccctgtgcatatcctccactgcagggctccggggctgttccatggcaacaatggaaagaatttggaataaatggttctgcatcatgtccttcaaggctccgctgtggtcataatagccgccgcgggtttccacgcccacttcttccagcgcggaaatctggatgcactcgatatgctccgcatcccatacattgctgaaaatagggttggcaaagcggattgtctggatattgcgcaccatttcttttcccagatagtggtcgatacggtaaatatgatccggagaaaagaaagcttccattttttcattcagcgctgccgccgcctccagactttctccgaagggcttctccaggactacttttccgccctgagcgccttccacctttttcagtccctgtacgatcaccgggaaaaacctgggtgcgaccgcgaaataaaagatatgattcccagcatttatttcatggtaaaaatcattgagttctccataggcttcttctttcgtgaaatccatacggtaatacacaatccgttcagccattcgctggtacacatcttccctgaaatgaagccttgcgaatttttccacccagtccctggccagttcccgataggctgtgctggtataatcccgccggcctactatcactatttgagtatcaaatggattgctgcctgtcatttccatgttatagagggccggaagcagcttacggaaagtcagatctccggttcctccgaatattgtaaatgtatttttctcactcatccgtcagcctccattcatgatggaaatttccttcccggtcaatccgttcataggtatgcgctccgaagcagtccctctgtgcctgaatcaggttggctcctaccggcatcccgcgggaggcgtccagatacgctgccgcctggctcatagccggaaccggaataccgtttaaaatagccatagtcagaatatgacgcaggctttcctgtccttcattaattttttccaggaaaaatggatccagcatcaggtttgtcaggccgggatttttttcatatgcacgggtaatatcatccaggaaatcagcctgaataatacagcctgccctgaaaatagccgctattctgccataatccagattccacccgtattctgcggaagcgtgggcaagcaattcaaaaccctgcgcataggcgattatttttgctgtatacagtccgtttcgcacctgttcgccaaatgcttttttatctgcgggctgtttcttttcaggagatacaaaaagtgactgcgcctctttccttgcctccacacggtttgacatgattctggcgttgcaggcagccgttatcatcgaaacattaactccctgcttcagggattccaggctggtccagcggccggttcccttctgtccggcactgtccagaatcatatccagcagttcctgatcgcttaagtcatccttctcccggaagatccctgcggtaattccaatcagatagcttttcagctccatccggttccattcgtcaaaaatatccgccatttcacggttgctgtagccgcccacatatttaagaagaagataggcctcggcaattagctgcatatccgcatattcgatgccgttatgcaccattttcacataatgtccggctccgtccggtcccatataggcacagcatggctctccctgggcctttgccgcaatggcttccagaacaggcgcaacatggccgtaggcctccctgtctccgccgggcataatagacggaccgaatctggctcctttttctccgcccgatacccctgtaccgaaataataaatccccttttctttcaggcttttctccctgcggatggtatcctcgaagaaagaattccctccatccaggatcatatctccctcatccagcaggggaaccagctgatcaataaccaaatccacaggttttccggcctttaccatgatcaggaattttctcggacgttcctgggagctcaccagttcctcaagttcatagaagggaacgaaattctcatggggatgctctttcaccaaatcctccgtcaccatacggctccggttatatcctcctactttaaatccgtgatccgccatattaagcgcaaggcttctgcccattacggccagccctataacaccaaaatctgttttctgcatttgatagtcctcctcgttttttctattacaaaacgtaatgttacgtctcattctctatttttgaaataaggatagcccgcagtacgcggcatccgctgtttattcttccagtatgacagatacggcttccggcatagtaatacggcttctgacttctttcaccctgccgctctccggatctatttcccggcagacaataccgccttcctgccgattggctataagcaggaaacgaccatccgggcttatgataaaatcacggggatgtacgcctgcgctggatacggaatcggctacagccgccttttcctgtgttaagtccactgttatcagctgatttaatccccgtacagatatatagaggaaatgttcatcacgggacagtcttatcgccgctgacgccgcccctttttcatttcccggcaaaaggggcagcgactgaatcaggctgaagattctgccgtcagccttaaaaacaaaaagctcattgctccactcgctcactacatacagctttttatgcaccttatcaaatacgccatgcctgggtccgcttccctccgggaacataatctctccggccggagcataatcgtcctctgtatcaaacagccttatccggctctgttccaggcacggcacaagcagcagggaatcatgaagaaggatttgatggcagccggccttttccccgcaggcgatccttttaagaatacgcatattttcatcatcccggccgtatatcataaccgtgccgtcatgatagttagctgtatacacgagcccgccgtcctgcaggatataacagggagtatgtctttcctccagaatttttatttcatttttaatctctccattttcaagccgtaaaaagcaggttcccgcttttccctcttcttccatgggaaaacaaagacggccttcgctgcaggaaacccacttggcatcctttgcttcatagaacagctccggttcttccagttccccgctctccgggtaaaaagcaaagcggtacacacccttgctgctgtccgaaaaataggtgcctatatagccattaatcatctgtttctttttattctctgctttcctgcatttttccatctgcttgctccctttcaaatctcacgtttttcttcaccgggttcggattcaccagttcacggacaccgtttccggtaccaatgataatcctgctgcagatccgatcgaaaatgcccgtttccaggactcccgggatctgccggatttcttttgctgcttcccgcaagtccgtatcctctttcattaccacatccaatatcatattgccgttatctgtaaaaaatgtccttccatccttcatccggcagaccgctttaccgcccatagcccggatggcttccgccgcccattcggctccgaatggaagcacctccacagggagagggaatgtccccagccgttttaccggtttgctttcatccatgatccagattacctgctctgccttttgggctacaatcttttcccggagaagggctccgcctcctcccttgacagcacagaaggagccgtcaatttcatccacaccgtcaatggccagatccaccctttctgtttcctccggacggatgacgggaattcccagggatacggcaagcgtttccgcagcctctgatgttgcgacagcctgaaaccttcttcctgcccggatcatggaacctgcttcgtgaataagatacaacgctgttgaaccggtccccagaccaatggtcatctgatcctgtatatatgatgccgccgccatggctgcggctttcttctgtttttctttattctccatcccgcttccgcctttcataaatctcttttgcattactgtaattataattattacagttagtaatgtcaatctcttttctgatatttcccaaaatagttttaccatttaaccggattcttaacaaaaagactgatattatcaggcagcctgtgaactgcttgacaatatcagccgttaactttagagtataagaataactaattaaccgggagtatttaaaactcattttcacaaaaaggaaatagaaatggaagtgtacaacacagacaagctatctgaagaatttatatggcaggattccatgggattaatcacaaaaacactgggtgctgccgccggtagccggaaaatatatgtcaacgtggattccgttcccccgaatgcatacagtaccaaatatcacagccactctcagcaggaagaattttttctcataatctccggcacgggcatgctgcggctgaatgacaaggaaattcctgtaaaacagggagatttcttcgccaagcctgccgctcagaatatcgcacatactttttataattcaggatctgagaagctgcttattttagatgtgggaaccatagaaaaagaagatacctgttattatccggatgaagatgtgtacatgcaaaagtcaaatggagaacgccgtattttccgtggttcggctctggattcttcctggtcttcggaaccgaacgaaaggctttgaccggtcctgttcacagaaaattttcgtttatttaccatcgcttcatatttctttcatgcttttcccgatatatttctgcaagttcctctggtgaaatggaatagcaaagcataacatcgttcagatacatcaatacatcgcacaactcttctataaaatgatttctgacctgctcatcatctgttattttggcgtctccctgcttcttgatgatatcggccacttctcctgcttctatcatcatccaaagcaggctgtcacgtcccttctcaggagaaagcccgccccatcgctctttatatttttcctgaagttctttctgaatgtcctgcatttcctgaaatccaaattcactcattttctctttttctcccttttaatattcagcggctgtctgaaaactaacaaatttataaaaaatatttgttaccctaatatatcttttataatatcattacttataaaagggagcaaagggaaaatatcctggaggcattctgcatgtaagccactcgaaagaaccattttatccacagtttcccgacttataaacggggccaggctcacgatttgttccatggttaaatcagccttttcaaactgcagcgccgctttatccgcagtttccctgcaggtaaatgcaacaatgttaagtaattcctgtatatctttaattttactcaaattttcacatactatattatccatcaattcccggctgataaaaggagctatagcattcatatcatatatactatttataagatccttgttgctttttacaagttctgtagccatatctcttcctacaaaggtaataatatattcgatttcttccatgctcccaatctttaatttatatttactgatatcagacggcttaattatgccctccaactcttccagttcttttatgctgatttcttcatcctgaggattgattaaccttttcaccgtacttgttttctcctggtgatctaatatctcatccactgatacctggaaaatctctcccagctccaccagtctcgatatatcgggcatcgtttcacttctctcccagctgctgaccgcctgaaagctcactcccattctttctgccagttccatttgtgtcatatcagcattaattctgtactttttaatctgtttccctactctggataaatcaaacatcgatcgtcctccctttcttttttcttacatcatacctatttatgcatgataaagaaagcaagtcctgcttgaatattccataaaattatcaagtattgcttgaatttatatcaatcaaagtaataaatttttaataacgacatttgtgaattaactgctgaaaatcttaattccggtaaaacaggaggatttcttcgccaagcctgctgctcagaatatagcacatactttttataattcaggatctgagaatctgcttattttagatgtgggaaccatagaaaaagaagatactttaccgccttataagaatccccttcatatattctgtttcattgtgtgtctgacagacgatttccttttcttcttccgtacatccaatcaatatttttatctccgagtcacgtttcatcaaatccacaatgcacattatagcatcaatctgttttctcgaatcagtcccaacccatacgtcaattcctccctgatccattgacgacgtattctcaagataaccgtaatcaattttataaataaaatccgggaatctcgggtgagccgttccctttggcctgtcaattacaatatttgaagcccttaccagtttttctattgctttccagaatgcttccctctcctccatatatgtccctcctcaatttgaacttacttattattttatacgaattatatcataactgcagtttgatttgctgttgattaaaataattttttcatttgatatacaaacaatagaaatatcactcaaagaaataaatttttaaatacgacagctatatgtcatacctgatgtgttataatttcttgtacaagcacaggaataatataaaaatctgaaacgaggttacacatggatattaattttgtgaatttaactgctgaaaatcttgccgacgagcatttaagctgcattatccgcagtaaaaagcctcatccgggtgttgaagcgaagcgtctgtggctttccgaccggctgaaggaagggcatgtattccggaaactgaatgttaaggccccggtttttattgaatacgcgcctcttgaaacagcctgggttcccataaatggggataactattattatatatactgtctgtgggtttccggcggttacaacgggaaaggttacggaaaaatgctgatggattattgcctggctgatgccagagaaaaggggaaatccggtatttgtatgctcggatcagcgaaacagaaatcctggctttccgaccagtcctttgcgaagaaattcggttttgaggctgttgatgccactgattacggctatgagctgctcgccctttcttttgacggaacaaagccggaatttgcccccaatgtaaaaacccctataatagaaaacaaagagctgacaatttattatgacatgcaatgtccgtatatctgtcaaaaaatcgggataataaaacaatattgtgaagagaagaatattcccgtatccttaattcaggtggatacgctgcagaaagcgaaggagcttccctgtgttttcaataactggggtgtattttacaaaggaaacttcgaaacagtgaatttaataatggatgtgtcccatttagagcgtatccttaagaaatgaacatgaaaactgccattatggaaggagcctgacctgttatgaaccctgtactcaatcagaataaatccagctgggatgccatggccgatacctggttcggatcaaccgcattacctgtgtatggatgcctggcgccgacagaggatgaactgcatctgtttcctgatctgtccggcaaaaaagttctggatatcggctgcggcagcggccattccctgtgctggtgcggacaaaagggggctgcagagctttgggggctggatctgtcggagaagcaaatctccaatgcacaaagctatctgacagaaaacggatatcatcccaggctgtataatgcccccatggaacaggaatgcggtctgccaaaagaatattttgatgttgtttattccatctatgcaatcggatggactacggatttaaaagccgctttctgcaatatcgcttcctatctgaagccgggcggtgtatttattttttcatgggatcatccgctgatgtcctgtgttgatgtgattgacgataagcttgttttttccggttcgtatataaaggaggaggctttttcctacatacagaggggacagcctgttactgtacagaaccgccgcatgtctgcatatattaatgaactggcagacgccggatttgtcacagaacgtctcattgaagaaaccgacagcgataccctttcccgtgcggcggaattctcttccggctattattctccctggagagcgcaaaaacttcctctttccttcattatcaaagccagaaaattatgattttccataaaagggcacaaacggaaaaattccgcccgtgcccttttttaattatttccgtgtctttcttctttttccattctttgccatgctttttttcctgaaaagaattgccgctcctgcaaagacacacaccgctattcctgctgctgcagccgtaaccattgtccatgagcctgccgtaagaaggctgccttgcttctgcccctgaacgcctccgtgttccttatccaaaaggatttcatcggaaacagaaccgtcttcgttcccattctctcctgtccctgctttaccggtaccatccgcctgtccgctttccccggcagccgtattctcacctgataccagaatgctggagggtccgtcttccggatccactatagttactttattgcctgactgcgatgtctgcgagctgtttttagagttcagcttcaccggagcggtactgaatataccgttctttcccagatcaggcaggccattcatatttcccatatccttaatgatataggaaggtatcttctccgcagtcttgggatcgttgacaaactgagttgtctcatcgtacagtcctgaatttatattgtcaccggaatcctgattgccatgatcctgactgccgggattctgctcctggctgttatccggctgaccttgactgcctccggggttttcatctatcttcccatctactataactgcttccagctcctcgtaggcgatatccggtatcttggatccataggccttgttcacggtctggatagaattctctgcaacactcacctcagccttcaggctgtctgcagagtccgccttctgaaatcttacggctcccagattcagattatcattttcatcaaacaagctgctgccggatgccacataaatgctcaggactcctctgtccttatcgtatcggtaatcctttacggcctcttccagtgcctgtgaaaaaaggaaggaaacgtcatccttgtttccgtcctgaacctccacattcaatgacatggatatggccgttatcttttctttgtttgcattggccatatttacggaaacagccacctgctctccctgattttccagggttacggtatctgtctgcgccgcgtatatacgctggggaaaagccaggctgagcaccaggcctgctgccaatcctaacatactatataatcgtttcactgctgctcctatctgcgcacttgcggtacgcatatgtatatcggtttcttttcctgcgggcgcagatccggacagtccggatctgcttctccatttgctgcctgcattctatatctcttattccgtctcctgatcattcttcaaataaatagtatccagcttctccagtatttccagaggcagggtatcgctgacaagtctctggccttcattggtcagcgcattgtccacacggtaaagctccgcacgtatctttccttttatggaagccgccagctcaggctctatccagtaaatccagatgccgtcgctcacctcacccagcaggccgttttccggtaccctggccaggataatctgttcggccttcagcgcgccgtccgtatcggtgccgccaaccacattgccctgttcatcataaagaaccaccacgttataggcaggatttcctttatagcttccggtaaatatcagggaaccttcggggatggatttcttttcctctcccttttgttcataaacatattcttcccctaatatccctactgcccccgcggtactgtccgatttggttccgaaggatatgttgtcaccggcaggccccagaagatccagctctgtcaccgtcatttccgggctgcttgttttgaggcgtacataagccgcatcatacgtacagatccagggatccttctgttcattctcaaaatatacggtctggcttccggatttattttcaaaggctcctgtctttacggtcgtccaggtgcttccgtccgtgctgatttcaatgacataatcccggatgggcgttccttccgccacagtcatcttcagaccgctcacctgcaggacttcatggagattcagcaggatcgccgctccgccggatgtggtttttccggtataggtattctttttataatcattatctatggcaaactgtatggcaggcaccgcctccggttcacagggaagctcttccgttgccgtctcttttttatccatatcggaggtcatattcgtggtgaccgtccagccagatttatcatggctgccatcgtgggatattttgaccgttcccactttttggggattggaacggtaaccgaactgatccacagcaattacttcataggtcatcactctgttattgatagtggtgacatgatccacaaactgtgtatccgttgtgaatccgattacccggcgtatcgctttccctcccgcatattcataacgagcgatttcataaccgagaatcacgctttggtcggaagccttgttttgtatggcaatggtcacttcgttaggtatcttgctgctgactgctgcgctgctttctccgctgatgatatcttttccgcggattgtattctccgttccatgctcgatttcatacactctggcatcatccgtaaaataataaacggctctttcttccctgtcaaactgtcccgcatagctgattgtgccttcatcaggctgcattccccagcgttcgaaaaattccagcagattctttccggcagccgcacaggccagtctcatcagtttctgatccgtatccccttccagcttcagggcgattcccttcggagcgggcgcacgggatgtattgcgggcgtaagaatccactcttgcaaaaaagagattcttctgctgttcctcataggtatcgtaggtcttataattatagcctctgtcataagccaggtggagctgccagtacagcgccagctgcgtgaatacatcggaggatcttcccaccgtattggaggtcaccttctgatagaccttatcgtattggaaacggatggagtcattggtatccttcgcactgctaaggagcgcaaaatagttgttggttatttccgcgatggcataggtgccctggttgatattatgcccgatttcatgggcaattccccagccaaacaggctgccgctctcatatttcccattgtcggcactcaccggcacacctttggcaagcccggatacagacccccattcaattcccacatgattaccggaggcatacataaatgcgccggcaaacattctcatgtatctgatattcagatgctgaaccggcatgcggtcggatgcaggcgcactgtcatccgtactcagccccttgtgctggtaaaacagatgaagcatctgttccatggctttcagcgattgatccagcctctcagccttttcctcagagctgccttttccaagccccttcagaatctgttctccggccacggaatacatcatctgatccagcataatatccgtcgcgccaagaatacagttctgtctgtcaaaatcccggttgaccttattgtcttcctccacggcatcctggtgaagctctttatgaagcttttccagattctccgtctgctcttccagctcctgcacataggtattgattcttgctttccgttctccctcatccgtaatgccatacagattgaggacgggttctttggctcctccgctgactctcacggcataacggtcggaactgtcatttcccgtatactgaatataaagcgctcctccgccttcaaaggacaggctctgtataggaggcactgtgatttcgtttcttcccaccttcagcgtcgccacatttacagccatggcgctcgcttccgcatgatactgcgtggcaaccagcctcaggccggcattggatccggtcttcagcttattgtgtccgacataaatgacaagctgttctccttcataggcggttactcccagaggctgccatgcattcaggcctccgaagccaagatggccgtccttcgccgccgtaattgcagggttaatttgtaccacttcacgcagctcagtattcagcagacccttcgcattatccagttccttctgaagagccgttctttcgggatggaattccccgcttttttcatcttttgtatccagacgtttctgcagctgatctatggtatcttccgttacgtcagccttcagcaccgtatgcagatcatctgcatacaacgccagaatgtcgtcctccagactgtcataataatagaaattgacctctgcaataacgatattatgatagttccccgaccgggtgaagcccagacggattttgttggcggttatggcctgggacagtttaattgcataatatcttcttccttcaggatcggttttctgcagaaggcttacccccttagctgccgtaccgtcaggatgagcttcgtcataataatagacatatactccattgtaatatcccagatcctctgcttcggcgaaggtaatatagttcattttgtagtaatcatccagcttaaacaacagtcctttatccgggctggggtaggaagcgccgtcatcccagtcaagaacctggtaataggagccgtagtccttatccgccacgcccaaagcgctgtttttgctgccttcgtccagactgcttcccaccatgcttccgcgtccatgggtgaccgataaaatgtgtgtgctcagctgaccctttccgtctgattcattcagcagcttatagcccggcatctgtgccggcgtcagcgtggtggtgcgcgcctccgaatgaatggacggaccgctttccccgagttcattcacaccggtcagatatacttcatatgtggttttgtccttcagttccgtaatcgtatattcactgctctgcacgccttctattttccgataagatgccgcgcctttttccttatagaaaatattatagctgtcggtatcaggcatgtttttccaggtgagccggattttccggtactctcctgtggcttttatattatccggcggatccggttttttggtggccttaggtatggcatcgatccccggctcggtatatgggctggcccatgtcccgttcacagaacgtacttttacatgataaacctggttgttcaccagcttgttattcatgaaattttttacctgaagttcatttccggccacacggataatctgtgttttgccgtcataagtgatttccacctcatatccggtgacattcacacaggcattccaggttaaggtaaaggacttgtccccggattctgcctgcaggttctcaggggtatcccactgcgtatccggaatacgtttttccatatcatttacaaattccactttggaaatttccgcgagatttccctggttcgatgtaccggtgatacgcagagtcactttcttcaccgctacctggcctcccaggttaataacaatactgccttcaccagtctgatccgcttcagccgcatacagccgcatccggcttcttgcctgaggctgttccttgcctatcggataaactttatcaccatccggggtttctaccaccacttcaccggaggtaatctgatgttctcccatagtgatgcgtatttcttcaagcggcacgctcttatccttttcctgctgctcacgggtcagaagattaaagccgatctccacaggattctcttcggaaataacctctccgtcttcccgtgccagctttacattgccgccgtcctcccgcagcagttcctccggatttccctctttcactttggttccgccggcctcattcagattgacggcaaccgcattgggcgaaaccacgctgcttatggaggacagcgtatccctgcccgctttcagattggcaaggctgtttacaaaatactgtaaatccttcagcgaggaaaattcctttcccgtctgtccgccgccactcttctccgcctcattgatgttatcaataattatatttttatcctcttcatccagcttcccgtcaccgtttatatcaccgaacagaagcacgcccgggtgaagctttcctgattcgtaggtacggtcaggaagggccagaaaatctgtatatacttcaacagacttaatctccccgtccatttccatggtctgcacatattcccggaatcctttggcagaaatgtgaagctcccatgtgccgggttctatatcgtcgaaggatattgtttctttatctttatattctgttttatccttctcaaaaacctttgtcctttcctgctttgtttccccatcctttaccagccatacctgcatggttactccattttccaggggaaggacattgccaatcgttacatcgattctgccgctgccgttctctgaagcatggttattccaatcgtcactgatttttttctgcctgctgccttttaaaagcagttcagtttcggtctcggtttctgtctcagtttctgtctccgtttccgtcccggtttcaaattctatatccgtgccggtttccgtctccgtttccgtccctgtttctgactccttttcagattccgattccttctctgattctgattttgtctctgtttccgtttcggtatccgcccccgcttcggtttcggtaccggattccgtacctgttacagttccggccatatttccggtcagcggttccgacggcttctccgttggcgtttccggcatactctccgtttccttttttgtaccggaatctgactgtgtaccgtctttttgtgccccttcggactccgtattgctgtttcccgctcctggcgccgccaatttttctttttcagcggaattgccggaatcatgtgaagcagacgtttccgatacggaaaccgctgttcccatcccggacgcctgggacggcaatacggtggttaccgccaggaataaggccatcaggcaggccaatgttcgtttcatatgtatcctcctcatatcgtactttatcttttcatttgggaaaaagaatctgctccggcagctttccttttcaaacacgctccggtatgtaatctccggggagcaaaaaaataagcgctgttcaatggataaaaaccatcgcacagtcgctcaaaaaaaacagcccttacctgctgctctctatcttttgcaactggctgccacataccgaataacggatacaaggccctctagctttgcgtcaccggctttcgccggctttgccaaatgaaatcatgtcagtgaaaaaattataacattattttccatcatttacaagttccaatgagttttaaaagtatttcatcatacgtgtattgttatcatcaatcctgcggtcggcactgtaacggcatacgcagacatcatctgtttattttataacataacaacaatatttgtttgacttttacgtaaacagatcatacaattttaagtaactgacaacgaaaaaagctccagcctgatgaaattgggaggtggagacagccaactgcagaatgggagatttacgctgatgggaattttattattactgcccttttttctgatacgcttcggactattatccttgctgaataaagaggcggtcggacgcgccgcctattttgctccgttacagggaaacgaaaagacggcctgcatattctatcagatttcaaatatagccatttttgtatacatactttttcttaaagtaagctatacacctgcgtggctcttcttcacaggcttagccgtctatatcgcaggagttatcttgcttcttgtttcggttgtgaactttgccactccttccgaaaatggcattaacaaaaacggactttaccgcgtgtcgcgcaatccgatgtatgtggcctattttgtctttttcctgggatatgtgctgctgacacagtccttgatattattggctctggtaatcatatttcagatatccgcccactggattattctttctgaagaaagatggtgtatggaaaagttcggtgacgagtatgttcaatatctgaaaagggtacggcgctatatttaatacctgtccgttttcagctatctgcggctggacaggcgcccgccgttaccgttattttaaaggcatattatatttcatacttttttaatgggattttgattctttttttgttatagtaaaaggacaggcagatgttctcacctgtaaacagaaatgcaagatagaatattgatacaggaggtattataaatgaaaaagaaattttcacttttagctttggctctggcaagctgtgtgaccgcacttgccggcaatcccctgacttcccaggcggctgaaatccctcagcttgggccatccaggatatggggcaccatgacaaaagccggaaatgatacaatcatatttgataaccagagcggtgaatcctaccagggagatattgtcatccatatatcagaggacaccaaaatcctggacgcacagaacgggttccccgtatcccctgatagcattcaggatgggcagactgcttatgcttatgtcggccctgccatgacaatgagcattccgccccagacgaactccccgatgattctcaccgaaatccctgcggactataaggtgcctgattatgtggccgttaagtccatggaggacaaaggggccgcctatctgctgaccgcagcggacggttcggaatttacggttccgaaggactgtactatcataccttatttaacaaggaatatggtctttctcaccgatctgaccgaggggcgcacctgccttatatggtccgatgcagcttcctccgcttacaaaatcgtactttttgcccaaaatgcggatgacggagacaagcctgcagatggggctgaaacggttctgcccgcttacggatggtttgaagaagacggcctgatttatttccgcaatgaggacggaagccttgtaaaaggttttatccaggtaggagagcagattttctttttaaatacggaaaccggagcgatgcagaccggcctgatcactatcggggacactacttttaatatgtttgcggacgggaccttccgtatcgaaacaaattaacgaaggaaccctttcttatgtaaaataagcaccggcccggggctgtccatttcgtgacagcatcaggccgtttttttttaattcttttttattacccttcagataccgttcattctgtctgtaatcttccttcggtaaatatcatctttatcccatcagcctccacacagggattgacataggatgcacgggtttttacttcttccggcttaaacagcagaagatccgcatagtaatcctcccggagcagaccgcgattttccagttgaaaacgctgcgccggttttcctgacattttatgtaccgcttcctgcagggtcaaaagcttccttcggcagacatactcttcgattattttcggaaaagcaccataaagcctgggatgcggatggctcccgcctccatagagcgcgtctgatataacagaggtaaagggcagggaaatcacataatccacatcctccggacacatgcttaaaacgataatccccacctttccttcctccgcatacatgagggcggctatagcctctgcttccgagtcaaacacgccgtcttttaccacttcctccagagtcctgccaatcatccactgattctcttccccttccagggagctgataagaattctgccgctgccgacagcgctgagcatatcatcccagccttcccatttttccttcagcgctttcttaagggcctttacaccctccggcgtgcccagcgcgctgctgagcctttctccatattcagcgctcaggactggaggaatcagggatcccagaatggtggatccgccgtcatagggatatacatcggcggtaatatccagtcccgacttttcaatcagagataccgcatcataaatatcttttttccaatttgccagccctacggatttaaaatggctgatattgatcctgactccggtcttccgggcgaaatcgatcacctcctgcacagaaggaagcaggccgtcgccttctcctctgatatggatggtcagaagcttatcatgctttgccgcttcccggcagaaagcataccattcttctcttgtattaaaacattcgggtacatacatgattcccgcagagactgcctgggctccctgttcaaaggcttcccccagcagcccgcaggcggtatccagttcttttttggaaaaacagctctgtccgaatcccttaaccgcaatccgtaccgcgccggttcccaccattgcccccatatgcagcggcagcttcttcgcatgcaatgcgtccaggtaagaagcaaaatccaggaaatttccgtccgcaggaggctttccgaggcagggttccaggaaacggtacattgccgctcttgagctgtcgtctgacggggcagggctcatgccgcagtttcctgcaagcactgtggttatcccctgttttcgttccaaatgcccaaaatcagggtctgtgagcgctgcaaaatcacagtgtctgtgcacatccacaaatcccggcgtcaccgcgaggccttccgcatggatgagcgggccttccgtacctgtgaaccgatctgttctgtgaggcagcacttcttctattttggtatcttttatcacgatatccccgcagaacgggtctccgcccgttccgtcatatatcataccgccgctgatatatgttctgttcattgtttctcctttaatccgcataataatcagcctggatccgataaagtctcttatattctccatccatcccgattaaatcctcatggcttccctgttcacataaccgtccgtctttgaacaccaaaatcaaatcacaataacgcgcgcttgctaatctgtgagatatgtaaatagctgtttttccccttgttaacatttcaaaaccttcgtaaatctttttttccgcgtccggatccaatgctgcggtaggttcatcaagtatcataatctcagactgcttgaacagcgctctcaatatcgctatcttctgcccctcacccccggaaagattcacaccgctcacatcgtaatctttaaacaataacgtatccagtccttcaggcagtttactgattatactgtctgctcccagcagctttgctttgccatagatttcctcatccttaattttcccttcgtttgaaaacaatatgttctccctgacagaaaaagagaaaagcttatagtcctgaaaaactacggccagaatattctggtattctttataatcataagtgcgtatatcttttccatttaatgtaattatcccttcatcaggttcatacagcctgcataataattttatgaaagtagtttttccggcaccattatcaccgattacagcaacccttgtaaagggtgaaagcttaacattaatatctttcaatgcatattcattttgattcggataccgaaaggaaacatgggaaaactctatttcagctccctgtacgggattgattgtcacaggaacgtctcctttgctgctgttgccctccagctccataaattctaaatacttggaaaagtatcttcctctgttcaatacttcaataactccatcaattataccgctgcaggcatccttaaaggaggctattgcactgaaggtcatcgtgaaatcacctactgtcagtgttttttcaacgagtattttatatccaaggactaaataggccatgttctcctgcagcatagataaaaacaagccgatatgttttaccgctccttccgaattcgttatctgatcgagtaatttataataagtatctgatagtttccgatatttatcaaatataaatttctgcagctgatttacacggatttctttcgcatattcaatgttcgcactaaactgcatataccattccatcttccgatcaattggccacagctcattatctattttatatctgtatttttttaatcgtgagtttgcatatgcattaactacgataacaaaggaaactattatcagaagccaaacatcaacagatgcgataattcccaaaactcccagcagaatcaatatactggaaaaaaaggtcctgaccgataaaatgagttcgtaaaaattcagagccataacgcatttagtcgcttttccgaacttatcttttgtatccgcatcgtccagcagtacataatccaaaacagacattttataaaaaagcctttgaattgcctcgtactccaaacgttttacttttttatccaattctgtattaataaactgattcatcgttttaatcagccagccggatactgccatactgactataattttaacagtcgccggataatcagcaccattcgcaaaagaatctattacctttctggataatagaatatagggaaagggtatcagcgctgatatgcaaacggatatacccagccatataaatatttttttgtcgattccggctataaaacgaaataataaaattatattagaccaaaaacttttcggctcagatttgtccattgctttttcctttactttaacatacatatactatttttgtatatcggcgtaatataaaatattttaaccactgtacaattcaggaatcaaagtatactgcatactcagtaaaagaaataatatagataggaaaatgatatgttaccagaataaatcaccaaaagaataaagagggaataacataccgcaattttatacaattcaaaccccaaatcataaagtaccatactctcaggcaggcaaacctgctaataaatctcaaaggagtgataaaaatggaatttaaaaaactgtttgacaagttcagtaccggcggaaagctgcttctaccggtttcagcggcttccttcgatgatattccctggtccgtgcacccgacgtttgacggtgtggaactaaagaatatcattacttccgatcagaccggcgggcaattcagctttcatctggtaaaaatcgcgccgggcaagaaaatcggcagtcacattcataaggaacagctcgaaacccacgaggtaattacagggacagggatctgcatcaatgatggagtggaattaaaatatgagcccggcgttatttctattttccaaaaagcctctccccacgaagtacaggcgggggccgacggcctgtatctgtttgccaaattcatgcctgcatcaaactagtgttccacccggccgggtggagccctgaccctcagaatcaggcgcaaacacatcacaggacattttataagcggtaggcgtcagtcccaccattttttcaaattgctttataaagtggctttgatcgcagaatcctgtgttcaaggccacttctgtaatcgtttccgacctattcatgagccgctgcgctttacgtatgcggttttgtatttgaaactggtggggcgtcaggcctacttccttcttaaagcttcggataaaatggtacttacttgtaaatgcggcacgtgccatttcctcaacactgaatttgctttcgggatacctctcaatccgctgcttcaaaccgctgaccaaggatgtatctgcattttccccgccccaaaagtcactctcattaacagaataaagataactcaggaaatgaataacctggctccggcttatttttctgaaatccccggcatctgtcagtatctttacaatttccgatttgatcttttcccagctgcagtcatcacggcttattatatctttccggatgcacaggctcaataatgaataattctcttttgccgtaatactatgcggtacatacggaaggatggcaaaaatctggtccttgccgtaaatttttgaactttgtccaacacgtaataaaacagacccttccaaaaccatgccaaccgtaaagacagaaacatggttatgaaggggatacgatattgcagaattatcgcagaaaataagttccgtaccactatgtatgtcatgcatataatgaatttttgtttcagccattccttccctctcttctatctgaaaaaaagtatatcataggcactgacaaacaagaaacaaactttcgttatatttttcgttaaatgaacttgacaaccattttatttgtgctatgatatggttatagaaactcattaaacgaattcaacaacgaaaggagctatttatgcaaaacgtaatcgaagaattaaaaaggatccaggcagccgttacaaatctgattgaggtattggagtcctccccggaaaacaaaaccgtgagcgcaacggtgggcgaaatccgttccgttgccatactggaagaaatctatcgctgcagcggatccgtaacgcctgaacaaatctctgaatttgcagtaaagtacggaaaaactcccagctcctgcgccggatactactccgggaaaaaaccttccttaaaagcaagcgatgacagaaaacgccgtcttttaacaaaacaaggcgaagaaaccgtgctcgcagcaagacaccgctggggtgatgactggctcgatcgtattccgcagtcaatcattgccaatgatgcgacttcttacaaaatggtaatagatttttaaaaatcgttattgcctgccctgctttcttggcaataagctgtccgctttgcagctgcaaccgctcctccatgttataatactagcacaacaaggaggagcctgaatgaatttagcagaaaaaatcctggaattaaggaaagcaaacggcatgtcgcaggaacagctcacacttaccttgtctatgactattttttgccatttgcctcacctgtattgataatgtcaatacaaaatggtatactaaatataattagaacttaatcactgcctgactatatagggaggtaatatcattatggaaaagacatttttacaggtacgtactgaaactaaggataaggagcaggccagcgttattcttgaagagcttggaacgaatttgtcatctgttgtcaatatgcttctgaaacaaattatattgacaaaaagtattccatttgaaatcaaaattccacagatttatacgactgaagagcaaatagctgaagttagtgcctctatggccatggagcaaatgccgttagacaaaaacgatataaatcttttgaaagaatatcaggaaagcggggacaaagataatatcaggaagcagcttttagagaattacaaggagagctaaatgagtgatagaatctactgttatcctgattcagacgtcttaatgaataagctgaacattcatgatgcagaaaaatttcaagaagccgaacgaaaactgacaatgcttcgattaatagatttactggataggccggtagcaggaaaatttgattttaaacatctgcaaactattcacaaatatatctttcaagatatatatccctgggctggcaaggttcgttcagttgatattgcaaagtcaaacatgttttgcaaagtgcaatttatcgaaacacaggcagacgaaatatttggaaaattaaaaaatgactgctatttagaaggactcccaaaagaaaaatttgcaaaaaaagctgcttattatttttcggaaataaatgcactccacccatttagagaaggaaacggaagaacacaaagagaatttatcaggcagttggcataccagtcaggttatattcttcatttttccgctattagtgagcaggaaatggtgcaggcaagtattgattcatttgtttgcaattataaaaaaatggaggctttatttataaaaattataaaagagcgataggtatatttttctaaatgggaaaccggggaatccttaccttggaaacagcaggtcagaaatcatcggattttaagttccgcgctcgcctatgtaatcgctctcgctgttttcgcattcctgcatctgccttatatcaaatcattcacccatgcagatgatatgcccttcagctggctgtcagccctgctgctgatcgctaccgctgtcgtgatacaaatcaacttaagaatcacgaaaaaatatctcagcggttacggcaatgccaaggaaggagaaacaaaaaatgaacggaaatgagggtgcaaagaataacagccgtgtaaaagcggcttatatcgtaacagccatctgcctgataacagccggaattctgttctattttctgtttacggccatttttgcagactggagattcaaaggggacagcggacagggaacgcgtcttgaattcaatacggacaatccggatgaagccggatttaaccgtgaaatgacaatctatacggaagacggcattacaaaggctgttttttcaggaaaaataactgtcgacggcacatcagaaattatcgttgccgccaatgaggatggcaggatagtctacagcggaacctattctgatctaaaagacgaatccattaaattagaaatcaatgatctggagccttacgcttactacactatcagcttctgcagcgacaatgcaaataaaggccatctgctgcttacctctaatgattctctggcaaaacgtcccgaaataccggagcatcccgatcacacggctccgtctcgtaactgatatggcagaatgaaagcgctgccggcaaaacttctgaaaatcttatggcagaatgcacaatatatagcagcttaatttttgtaacttattgttcttacatccataaaaattttaagctataatttataagcgatgaaaaaacaggcagtaacttgaatgtgaaggccacacatttaagctactgcttttttgtttgcaataagtataaaaacaggctgccggtcagctgtgcatttgaaaggagatttttatgaacagtaactcaaaccaatatctggaggaggctccgattggaaggcttatgatgaagtttgccgtcccctgtatcttgtctcttctggtttcttccctttataatatcgttgaccagatttttatcggccggggcgtcggttatctgggtaacggtgccacaaacgtagtatttcccattaccgttatcgctttggcaatcgcattaatgacaggtgacggctgcgccgcattcctaagcatctgtcagggaatgaaagataacgagcgcgcaaggaaatgtgtggggaatgcggtttccctgcttatcctgagcagtatcattcttgttgttctttttgccttcggcaaggaagccattctgtctgttttcggcgcaactgagaataacatttcttacgcgagggattattttaatatcattattataggaattccttttttcgtattcacgaacggcatgaactccattatccgtgcggacggaagcccgcagttcgctatgataagcacgctgatcggatgcgtaatcaatatcattttagatccaatagcaatctttgtcctgcattggggcgtgacaggcgcggcgcttgcaaccatcgccggacagtttgtatccgcggtgctggccgcatactatctctttcatgccaaaagcttccgtctggatccgggcagcatgcttatccggttcaaatatcttgcaaaaatactgccgctgggcatcagcagtttcctgacccagctctccatcgtagtgatcatgggggtgatgaacagtactttggtaaaatacggcgccatgtcaaagtatggggcggatattcctatgacagtcatgggaatcgtcatgaaggtattccagattgtgatcgccgttgtggtgggtattgccgcaggaagccagcctatcgtcggttacaattacggggcgggacatatggatcgtgtgaaaaaaatatataaaaccatgattgcggccgaagtcataatcggcgctgcggctgcctttttatttgaatgttttcccataccgatcatcagcctgttcggaagtgaaaatgaactgtacaatgaatttgccgcattatccttccgtattttcctctccactgttattctttgctgtgtgactaaagcgaccagcattttcctgcagtctttggggaagccggtaatgtccatgtcgctttcgctgctgcgtgattttattttaagtgttccgcttgttttatgtcttcccgccgtttttggagttaccggcccgctttactccgggccgatcgctgatattgtttcctttgcggccgcgctgattatgatgatctccgtatttaaaaagctggatacaaaagtgacgtcttcaggcgaaaacaccggcttttctgtccatggcgtccgtcacagcgcgctgtaactcttccacatcatagggttttgtgagaaatgcaaagccacctgcctccatcccttccttcgccgtctgcgcatcggagtgggcggtgaggaacactaccgggatgtccgccctgctgcacctctccctgcagaatgcaaggccgctgccgtccggcagatcaatatccaggacaatcacatccggagtaacctcctccagaaccttccctgcttccctcagtgtccctgcactcagtatggtatgaccctgaaggcgcaggatccgttcgttcagatataacaattcccggctgtcgtccaccagcaggattgttttcccgttatgcccggacagttccgggttcggcttctgcctgtcggcgcggagcctgcggagcattaacagatctctctggccgaccagcgaacagacgaaataagccagtacttcaaaaaggattgaaatatgctccattttttccggcggcggattatccgcccctaaaaagccatgtatctttccctgtgccatcatagggcttaaaataacggagcggatattctggcgctgtaaaaattcatagatcagcggatcactctttagcaggctttccacatccggttcaataatattttcaccgtccgccaaccgctcataccagggatacagatcctttttcgccacatagggaagttcctgtatgccggatgaaacatggctgcggcaccattcataggtattatggatatgctgccggtccatttcttcaaatacatataccctgtcgcattccagccgctcccccaggaaacgcagaagctggttcagcccctcctccgcatccggggcctttcttatttttttcagacattctcccacaaattgttcgttatatgccgcattttccttcacgaaggcacctcaccttctccatacataagcgtatccatcgctaacagcagttccgtttcacttttgaattccagaaccttctcctctgctgtcagcttaccctgccaggtataattgcggcattcctctatacacacctcaaacgtcatctgagcctgttcctctctcatacgcgcctccttttttgtatcagaatagcagaaaaaaataagaaaaacgcgaaccttaccaatttgtcaggttcgcgtttttatcttccgtaattcccactctgattccggattatttttccataatctccagcatatacccttctttccggaagctcatcagagagatttcatccgaaacagccagcttatttttcagccgggacatacatttccaaagggctcctgcattcccggacatgggctgtttccatactccttcatagatctcatccgcactcaggattctgccttcgttccttaacagaaacagaaggacagaaaactcacgcgcggtcagccgcatatcctttccgtccagaaaagcacgaagcgccacggtatccagcgacagagggccgcgggccagggcttccgcctgctccgcatccctgcggttcatcctcgccaggcggagctgggcattgacacgggcaacaaattcatccacatcatagggctttgtaatatagtcattgccgcctgctacaagcccctcaatgatttcactcttttcgtccagagccgtcagaaacagcaccggagcggatgtggcaggacggattttttcacaaaaggcaaggccgtttccgtcaggcagcataatatccagcaccagcgcgtccggcgtgtgttcccggagcagctcctgcgtctctttaagggtggaggcgcacagcaccatgaagccctctctctcaagaatacgcctgttgatgcgctgaatattcttatcatcctccaccagcaggattgttcccttttcattcatgttccgcgccctcctttaccggcagagtaaaccaaatccgcgttccttcgccttctacgctctcagcgccaatcttgccgccatgctcttctatgattgttctgcagatagtgagtcccaggcctgcgccgccttccccgccccgtctgaaacgctcgaatacatgaggaagaagctcagggctgataccatcgccgttgtccgcaacactcaccctgagctgcttccccagattttccacccggacggaaaccctgccctttcccgtatgtttgttggcattgctcagcagattgatgagcacctgaaccagctgtccggcatccccctccacggagggcagatccggatccacctccgccgtcagtatattttctttctgcttaaacatagactgataaatccggacagtctccagcacaagggaatccagagccagaacccctctgccttccgccgctccctgtatccgcccaagccccacaaggcttgttaccatcccggccagccgcctggcctcggcggaaatggcggtcagatccataaccgtttcctcatccaccatacctgccctgatgttctgtgccgcaaactgcgcattgacggaaataactgtcaggggtgttttcatctcgtgggagacatccgtataaaactgattcttcagccggttcatctcctccagcatttccttttcagccgccatgctctcttccctctccctcgcctggcgcacctcctgcatggttccgaaaaacattgccgtcatggcaaacagaacaaaaacggccatcgccatttccgatatcgaaaaccgcagcgcaggcagaagaaggatatcacggtgatacagcgtatcccaaagggccgccgccagcaggaaggcaaagccaagcagcacggcgagctgtgccgcccccggtttcttccagcacaggaacagccgtataaaaaaatacagggcaattcccgccagcagcacgatccgccataccgcagtataggatatcagcagcgtggaaccgaacaaatcgataccggcgaagcccgcacaagcaagactggcggcaagcgggaaccatttgggcagcaccccgggaaacagcagataaaaaagccacacaagcagaattccgctcaatggcatggtcagatattccagccggaacaccgccgtccagggcagtcccggcaaaacagagtccagtatccgctgtcccgtaactccggtccggaggaaccaggtaaggcagaatagggcaaacagcagattcggcttataccccttcatcatcagataaaggataaagtggacaagaaacagcgccagatagccccccatcaatatcacttccggccacaggttccggaacgtataccggttaatccattccggcatacctatgtagagagtgccatgcgtgcctccgtccttatgcgtaaaattggatgcctgctgtacaatgacaatctcaccgtcggcatccggcgataccggaagctgataatattttacaccgggcaccgttgtctcccggctgtccccgggcaccccggcttcaaaaagcagcttcccgttcacatacatccggctggcaaagtccacactataaccgcagatgagatagcttccgggaagtatcctgatccgcatacggctggtagcatactggatttcatttcccggctgtcctatgcggatatccggccgtccttcaaattcctgcggggtcagcagcgcgttcggcacatattccacatcccctgtaagccgcaccgccgtctgcataagctccgtatcatccagaacccatatgccgtctgcggaaacagccgtcctgacatcatccgtacggggcttgattccccataccaaaaacatcactaatacgatcagcggcaggacggcagccaatgtccatctttcttttttttccaatatatcaccgcccctccctctgcttataatcatccgttacattctttccctttttccttccgaaggagctgtcactttcttttacggtacttcttttctataatccggatatagaaggccatggctattatagtctctattattatccccacagtggaaaacagaatgaatggagcagcctgtctgcttaacagcggaaatcccagaattataaaaacaacgccaaatatgcacagcattttccctaccgcataattatatttcttataatccgtcacttcaaacatctccatattggcccatacacctaccgcctttttcgaaaaaaaggcaaagatacctatggcaataaccgcaattcccacgaaagcccaaattataaatcccaacatgactgcttcctcctgattctttaaataaactccctggtaaagctgttcatctgatgattgaacccatctcatccctatcctttattaaagctgaaaaccgttccgctatcgcggcggcatttatatgaaaatccaccatcccgtccacatacatgaccggacaggtaagagtttccgcccattcccctatccctgacagggaacgtgcggctgcaaaatcaaaaaactgctgttcctgttcatacatatcaccgcccttgcagacacgctccccgtatttttcacgggaacgttgttttatccgcgacatacgcacctcatgcggagccgtgatccctacggcaagcttatacagccgctgtatctcgtccccaaaatctcctgtgacggcggtgatgacaaacgaaccatatttttcgatatcgaatagcatcagctccagacaatcctttcgtgaccttttaaccgtatacgggatttccgatttttcaaaataataatcttctatatccatgtgcctgaaccccagcagccccgccagttcccgtccgagcgtagtctttccgctcccatttgccccgaaaatgattataccatgtgttttatccaaagaattgtcccctctcttattctacttgattatatcaaagaacggttaaaaagaatatatcccattctgcatacttttttataacaatatgcatacggtacaaagttgattaatatggaaaaatgtgctacgattgatacgttgatataataacatttacataatgtaatgcaaagtcaggaggtgctgaaatgaaagttgtaatagtatggtcaagtcccaatgaaaatggtttaaccgcctcagcaaaagaaagtttcctgtccggactaaaaaaagcgggaacggaatatgaggaagtacatctgaacaaatttaaaaccgaacactgcctcgcctgcgggaatggctgggggacctgccgttccgaaggacgctgcatcataaaagatgatttcgaatccatttaccgaaagctcatggaagccgatgggatcgtctttatttcagccgtatactggcatgatgtaaccgaacatatgaaagcgtttatcgaccggctccgcaggtgcgaaacaggccataatggatttttggcccagaaacgctgtatcttaatcgcctgcgcaggaggcaccggcttaggcgccattgagtgtctgtataatatggaagaggcgttaaagcacatggggatgagagcctatgatcggattcctgttatccgttataacagggattatatgcttccggcgctggagcaggccggtgaggtgtacgttgaacggttaaaagacgggtttgatatgcggtattgattctgcataattaatagcctttatcatttgatatttcaatatttaagattgtttctcctttgccggaaatacgacatccgcgctgcccctgataagcagcggcggttgccgtattccggcttcttttacggtttccaatccattaatatccccttctccgatcccatgaaactataatgtataatgataattagaaacggataaaatttatcagaagaactatttaaaatttgaatagatacaaggagttagtgataatggaaacgagctggaaatctgtcgccaaagatggcaatccggtaacagatggagaatatttggtaacagccattacagaatcaggaaagtatgacacaaaaataggggaatggcaaagaggttattggaactttgatacaagcatcgttatagcttatgccgcaaaaccaaaaccataccagtggtccttatttaaaagagatatggaaggaattaagtatatcttgtgattattcaaagctttctgtctttcttaatgcgttttctattgcctttagtaccgtatcgctggtaagtgtagcgccggatatggcatcaaccttcagggattgttcatcacagacagcttcagcaatttgctttgcctgctccatgtaggcggtcttatgctcaatcacttcaatattaacgatttcatgattttgtatctccacctgaacgacagcaaagagaatcttattctgacatacgccaatatacgtcccgtccgcaatcgcacccagttcggcgctgccaacctgtaaaggctccggacgtaataaaaatgccgtaaatacaaaagaggcacagaacgcagccgcaatcgttgccaagtatgggacagcttttttccatttttctttcatcttgtcgccctcatccattcaaaaaagtcagcaggtatcatttaccttatgataacctgctgaccttaatataaatttcaggcaaccttaattaaccttaatcagtcaaaaactcgattggaaccctctaaccacgccgtcccttataaatacccagttttccctcatctatcgcatagatatgagtacaaagtgtttccaaatcatcataattgtgggaagtcatgagaattgtccgtccctccgcctggaggatgcggataatttctttgatatcattgcaggtcttatagtcgagtgcattaaatggttcgtccaaaatcaatatatcctggttttccataatagcctgtgcgatgccaagcttttgcttcatacccagggagtaatgctccacctttgttttatcctccggatcgagtcccaccttctgcatggcggaacgaatttctttatcgcctgccacaccgcggattccggccagataccgcagattctgcagtcctgtattaaggccgataaaaccgggggagtttatcagcacacccatgttttcaggaaaatcacgtcctttgcccaggatctgacctctcacgcagacctgtcctctgtccgggatcaggaagccgcagataagattgaacaggaccgactttccactcccgttagtcccgactatgccaacagtactccccttttccacattcagggaaatgccggacagaacgcgccgtccggaaaagctcttgcttacttgttttaatgaaataatgggttccatagattatcctcctagtataataatggtgtagtcaagaacgactactaagttaaaagttacaaagtccaatctaatcaatctatatagatataacggaaggaggagttctccctccatcagaagttataaggcaaccttatttaccttgcctgaggtttccttcatgcaccagacaaaagatagaggtataatcacggaaggcaggattatggacgtttcctccttgggaaccggccttttggctggtgaaacctctaaaaaagtctgtcagtccattcggtggtgatttatgttttggctggttgggatgccccaggctatacctgtataacccgctaggttgtgtatccaccttctggaattggatacctgccagaaaggatcaagttatgcactatcaaaaagttctcaagatgctggaaagcatcccctatctctctgtagggcttgatgtcggcgctgatttcacctggatgtccatcatgctcccaaatggcctcctcactggaaaaccctttaagatcatccactccgatccgcagtcccgtgagcttgctgtcacaaaaataaaggaagcacaagagacgtattctctcaaaagccgctgcttccttgagtccaccgggatctatcacatcccgctcctgtgcttccttcgtgataaggggtttgactgctccgtcattaatcctatcatcactaagaatagcacaaatatgaacgtaaggaaactgcataatgacaaatttgattcaaaaaaagcggctagagttggactggatgcttccctaaagacttccatcgttccggacgatgagatcatcgacctacggaacctggtccgtgattactattacttcaaagacctacagtcggcggtcgttctcaaactacatgcagaactgaaagtttccttccccgcttacctacaggtgttcagtaagatcaccacgcagacttccttaaaccttctatatgcataccctcttgccagggacatgcttgccgctccaaaggatgacatcatcaaaaccatccggagcacagcacgctttggggaaatgtatgcccttgccaggtatgacgccttatacactgccgcgaaagattccgaattgttcgggcgcgcccttcccagcaatgccctccggattaggctgtacatagattcttaccgggaataccaggggcatctggactccattctgcaagaactgcacaaggctgtagatagacttcaggggaatcctgcatataaccgcatccgtctcctacagtccctgcgcggcatcggctttttaagcgctgttgtcctaatcgcagaaatgggttcctttgacttatttccttcacccaagaagctctatgcttactttgggttggatcccggtgtaaatgattccggcaagctcaggggagacagggtccacatgtccaagcgggggtccggtcttgcgcgtcgtatcctgcatatgattgccataaacaacttaaaaatggagaaagggataaaaacacctgtaaacccggttatttatgactattacacccgcaaatgtgccagcaagaaaaagagggttgctgtcggagccgttatgcataaaatctgcaacatcattttcgctatgctgcgggataacaaaccttttgagatcattacacccgaagagcattgtaaacgctatgtgacagaacagtctgccaaaacagaaacagcagcttaaagatccaccactatgaaatttttaaattcccatatccgatgggtttattaaagtcgcctttttttacaccaactgctcaaaaaaactttttaaacatttttcactttatttcttgacatttcttagctggacttaatgattgaacagacgcttaatgccccggccggaaagccagaggagcagggccagggaacaagtccccagcagcacggctgcagccgctcccggcatggttccgcccgtctgcggaaggttcagccgcgccagactggaaagccctgccggaagccatgaaacgggcaacacacaaagaaaatgcaacagcacgacggtcacaaaccctgccgtcgcctgccccgtcacgcataagaccgacaggatcagcaggaattgaaacccaacgtccaaaagcttcagccccactgcggttacgctcaggcctatatccggtgaaaagcctaacagcaggggaggaacggcagccgcaaggataagcagacatccatacaaaagtatccagagaaacccggtacagaggagcgcctccagaagctcctttcttcgccgcaggcggactgtcagaaaaacggagcgttccccgacagcctgcgtgcagaatacccccagcggccacaggggaagtacctcaatggccagcagtgccataaagcccatcggataaaaagatccggtgccgtgccccgcaaacaggcggatcagccaatccgtactatcctccggcactccgccggaaatccaggtccaggccgtcacaagaaaaatcaggccagccagaagcagtccgttttttccggtaaacaggacacgtcggtaatagggccccagtccctttttaccgcggacggacaccgaaaaccgccagtaccaccttcgggtgacaagccacaccattcccatcgtcactattgccgtggtcacagcagtcagcggcaggcgccatggctccgccagattgtgaagcagaaacacccagtggttccatccggtcaaaaacacaaagggcgggcgggacataaccggcagcttaatccagagcgctgcgaataaatagagcgccaagagcagcttgactgccagggaacggctgcaaaagtggcccaggcaaagggccgtcagggcaatcagccagtatcccaaaagcatttgaccggcacagcagaggactgcggcccatggcgacgggaaatacccctgcagcagcgtaaatacctccctccactgtcctgacggtgctcccggccagcttccggcgacgggaagccccagaccggagcatagaagcgctgccatctgcacaagccagaagaataccgcaatcacagacagcgcccgccatttgctgaaaaaataccgtccatacgtcccataccgcaccagtacaaaaagcatatcgtcctccatcacaccggtacaaagaaacaggaaaacaggaagtacggcaaaaacgaaataatactgatcattcaggacggccagtaaatgaaacggaagtaagccttgcgcacttcccctctcactcagcccgaataaaagggaaatcccaaaaatcaggaaaaacttcccccgtccgaccatcatccacatacggttcatcataggcctacacctgataaatgaagcgttttttcaccttttgataatagaacgccaccactcccatcacaatacacatcaaaaccggccccgccacaaaggatgcggcatgaacagccgaagcgcttaagctgccgggttcaaaggctgtcacaaaacgaagtcccggcataccaaggactgcccaaaagaaattctccaaaatgacatagataaacggacctgtcaggattacgaatatattgctgccataaagagccagtacaaaacccagcgtcattgtcagtatgcccatcagccccttccatatagaaagcaataacgcatagagaaccggcgtttcggcatacaagtccaggaaaacatgggcgtagcccacggggagcggccaaagcttctgcggtgccctgacatacagcgcaaacagtgcggagacgaaatagggtatcataataatgataaatgcagccgccgcacatgccccccactttgctgtcagataacggcgtctgctgatccggggcagggtgtaggtcagaaaatgatcccggcgttcatagtaaagttgccagcaaatcgggacggtaacaaacaggggaaacaaaaggcttaaaaactcggtgccgatttcccatggatcgagttcaaaatggattgtatactcacgatacagggtacaggatagaatacaggtcagcagtgtaaggagacacgttgtgaacaggaccggcctggctattttctttccttctaaaataaaatttcgcatgtcagcacttcctttccattgaatttatgtgtttgcccctttatattagcatcctccttcataaagacaagactttgggaacaaacaggggttttatgggaacgaaacggcccgccccataaaacccctgctatggtattcttcaattttcagggaaccaataccccgatggttatatagggtattccgttcagctgttcattgccggtaataatccttcctccatgccgttccgcaatccggcggacattatacaggccgtagccatgtccgtcttcccccttcgtcgaccagccccgccggaacatctgtataaactccacgttggataaagcaccatggggattcagaacagaaaaccggagaccgtccgtttcctctgccgctctggcgtacactacatctccgggcccggcagcctcgacggcattgtccagcaaaatggcgatcacctccacccagtcggcttccgataaggcatggcggagaaacgcgccagcaaccgtcacctccacacaaacctgttttagttccgcctgcttcatttttccaaacagcagcccgctgataactttactgtcacactttaataactccttatccgcgccgtccagcctcacattctgaagcagagatgtcaccgcttcctgtgcatcctgcaaatcctgtgcggcagaaaccgctgctgcaaccgccatcatctggttgttaaaatcatgctgacgcgccctcacctgttcaatcagttcttccaccagaggaagatactgctccagcatcgctgttttctggcgggcctgaatacggtgctgccgaaggagcatgacaatcccgtcgcaaaccgccagcagccccaccgcacccacaggtaccggcagccggagaagcattgcggaaaggtcaaaccggaacaggaggagcagcagcaaaagaagcagcgccgtattgctgcacaccatacaaatgacaggatccccgtccgccagcttctccctcagccaccggagcacccctgtgctccaaagcaccagcaggaggaaaagggacagagtccggcccacataaacataccatacaggctccgtcaggccgcacagggccaggaacagtaaactgaattccctcagcagaagatacagcgcaaagacggcaatcgtgccgaagagcgtatgcccctcgctcttttgaaaccacaggctgtttaataacagcactccgaggaaaagaaacagaaatgcgacgatatgatccaccgggagcacagcatatgccatttccgtctcctgctccccaagtcccaggcgggagagcagacagacaccggcaaacagcagcggcagcagccgatccggctttcccctggacctgccaagcagcccgaagccggaaagcgacaggagaagcccgtccaatacgctctggaaaaggatagaaattgtcatggcttttcacgctcaaacactgctttctgatatttctcgccaatcgggattgcggtttcgcattccttcaggtaaagcaggcggtttgccttgtctattttacaaatatgaaccggattgatcaaaaagcttttatggcattgcagcaaacgatcctgcggcaccatactcagaagctttgtaaggctgtaaccggaaatccggtctgttacttcacttccgccggtctgtgccgtatggatcaaaagcctttttccaaaagattcaatgtagagaatattccgtatctcgtattcaaacagaaactgcttctgctcaatccgaaggatttcaggcaccgcctgcatctgcgcccccatctcaagagccgcatggaatgtcttttgaaattcctcctccgtaaaaggctttaccagaaaatcgtagcacttaatttccctgtaggcagacagctcctccccggccagttccgtggtgaaaaggatcggggtaaaccggtattccggcagggcccgcagctgccttgccagctcggtccccctgtaatccaaaagctgtatatctaaaatgaatagatcaaccttgttttgtgccgcaaaggaaagggcttctgccgcctttccgaatacggcaagcctgtgtccatctgagctgttttcaatgtaccggcgcagaagtgccgctgcgcccggctcgtcttcaaccaataaaataagtcccatgggaggctcccttcacacatccttcaatgcagtgataattatatcataacttatatgagaacacctactttattttattggacgcttctccgttgccagcaagtacacagccctttcgcagctgttctgcttcttcctcatttacacctgccggggctgctctttactaagaactcataaataggaatgcagcctccgcaaatgtaaaaataatgctgagtaccagggccgcccggcacagaatcagagaagccttaagcgcatttttacccctgctgctcttttgaatatgacgtaatcccataatgctcaggacaagcccgacgggagggaatatgatactgaaaacaatgccaaaggttcccagaacagaagctttgcgtgcactgttctcccttgcatggacctgcgcctgcagttcctcattaccccggttgatccgggcagctatttcacctgttaaccggccgaaccgggcacattcctcctcctgaatgatattcacatggtggtagctgtcctttctggtgttgttcacctccacaacacagtccagtaaggacgcgccgttcttatcatacagggcgcagtccacacgccgtatcctgccttccctgtcttttttaatgctgacgtcggcgacgcccaatatatcttccgtgatcaggatcggctcccccggcaggataagctccttatcaaaggacaggggtatgacccagatacggcctgcgtcacaggcaagggcataggaatagtaggtaacataggtcctgcgtccatagtgtgcctctttttcaaaatgaccataggccacctgatagccgctctctcccggcagagcccgggccacggctttcctgagccgttccttgtcctccccgtcggcggccttgcgcaggtttatcttctcccgcataaaaacatagactgcagccgcagccgcaataacaacaataatccatatcagcttgctatccatatgtaatggtatcctccgtttttcatcatcttcagggtcagctgactcttaccaacaggtaaaaaacagtataccatcccaatataattttttcttgtaagatatgacaccgaaagcggtgagacaaacggagaaagcggcgggataaacggacagcacctcataccgtcttttaagccggatagaaacaacgccggaacaccctgccggtcaccatccttttttacggactgccctcttttccctgcttctcttctccgcagtttctgccctgggcttcataaacaaaaatacaactcccgcaagcagcatgacggaaacactcagcgcgcaaagcggtatattccactgaaccccttccgcatatccacggtaatttatcagtcccaataccgcagaaacaggataaatatactgtaattccccactggcgaacattcctatgaagccataaacaaacgctgcaatgacacccgcgaaaaaattgcctcccttcctgcccgtcaatacaatgatgggtattattaccatatattcaaacaacgccagcagaggcatctgaaccaggcctgccagcacatttttgaaaaggatcccatcatatcccatgatgaaagcgccggcaacggtaaaaaggaaacagaccatccccaaaataagagacaaaacagcggagaccaccagcttgcctgtcataagctttcgaaaggatatcggaatcacaacaatatttttcagtgtatcatcggtgtattcccttgaaatcatatagcctgttatcagcgtgatgcacataggaaaaataagggtgacaaaatttttaatcacctgctcatacaaaaacaggaaattccaaaccatgccgtcctcggccagggaagtgaacagcgtcagcagtacggtaaggagcatgagtgacacgccaatccatagaataaagtatctttttaatttcaggaattctgtttttataacccggaacatattactcactcctttccttatataaataaatagccagcagaacggagattattccgatcactcccaatgtgagaaacaattgtgcggttgacgggatcagccccagttcaacaaaactctgcagatcagccgcatcctccatgctcatatgctctgcaatctgccggctgctccacagcataatactcggagtcggcagaaggaatactaaaattctgggcattgaagttatggtaaaagtggaaagcagattgaatacactgtaaaatacacacagcataattgaaaaaatataagtcttactgaaaaatacaatcagtaaaaccaggggcaatgcgctgagggcaatcataatgccgtccaggacagaaaaaagcagcttgtagataatatttgtcacatcaaagaaaatactcccgcataaaatgctggctgccgttgaagatatgcaaaacaggatactcagcagcagcagcacggcatacttggcggctaccattcccgtacttgtcacaggaatggtcctcagattcttataggtgtcgttatcccgttccataaaaaagagctgtgccgcaaggatccccaatatacatggaagcagcaggagcatgccgaagcccataacagactgccacaatgcatcaaaagctgccgccttcgtcgaatattttccctgtgccgaattcaggcggtaaacgataagggtaagaggcgccggaaaaagaaaagacgccagtaaaaccagctgcacgaatctctttcttttcagcttccaaaattcacatttgatcagcttaagcaattccttcacccccagtcacctttttaaagtaatcctccagcgtgtcctcacataaatggacttccgaaacatccaccccctgccgcacgaaagtccggttcaccgcggcagccggcaaatcaacatccaaaagccggatactgttttcctcacagatctcataatttccggtaccgaaatctttttccagtatctctgcggccttacggctgtccgaaacgataaaccggatatagcggcggtttttcctctccatttcttccagactctcctcttccagcagcacccctttgtcaataatgccgatatcatcagccagaagcgcaatctccgacagaatgtggctggagatcaaaatggtctttccgctgatatcacaaagctcccggataaaggaacgaacttccgcaataccgatcggatccagtccgttaatcggctcgtccataatcagaagctcgggattgtgcatgaccgccagcgcaatggcaagccgctgtttcattcccagggaatactgggaaaatacttttttatcccggtaaggcagattcacaagctccaacgccgtctttatatccttggaattctttaatcctctgagctccgcaaatatcctgagattctcctcagccgtcagattgggatagaaacccggtgattcaatcagacttccgatccgcggcagcaccttgttttcgtttccggcaagaggctctccgaatatcctgatatgtcccgaattgggtctgctcagccccagaagcatgcgcatggcagtcgttttccctgctccgttgcggcccagcagaccataaatccttcccttttttacatgaaggctgatgtgggaaacacatacctggttcccgtattttttagtcagatcattggtttcgataatatagtcgctcataattttgaacctccttttttcatctcctgaccagattaacatgccaatcctgagataactctgagcctgccttaatttttctctgagatttacgcgatcaaataggaaaaccggatgacttgccctataataaagacatgacagaaaggagggccatatgaaggacagagcaattcttcttgtggatgatgaaaccgatttgttggaaatgcttcaatctatttttcaacgggccggatatacccgaattttaactgctgcatccgggaaagccgccctgagaatatggaaggaagcaaagccttctatgataattcttgatgtgatgatgcccggcatggatggaatagccgtactgaaggagatccgccggacaagccggatacccgtcctcatgctgacggcccgcggcgaggcggaggatagaattgcaggctttgaaggcggcgcggatgactatctgccgaagccttttttaccgaaagaattattgctccgggtacaggcaattatgagcagggcctacccggaaaaggagcgcaggatttatctggaggctgcgaccattgatttagacaaggcggaaggctggcgcggcgagaaaccattttccctgacggcaaaggaactgcagctgattgaaaagctatatgaaaatgcaggacgtatagtcacaaccggctcattatgcgagactgtctgcggggaattctggcagggctatgaaaccactctctccacccatatccggcatctgagggaaaaaatagaacagaatccctcaaagcctgtttcccttattacggtgaagggcctgggataccggctctatctcaaaggagtgaaaagatgaatgctgttgaacgttttttccgccgctatatcatttctacggtcggcatcctggtccttttttttaccgttaatctcttattgttgggaacctttgccctgattctttatctgaacggcgccgcagattccagtttcccgacagaagaattttccggccatattgttttacagaacggagagctcacagccgacgccagtgcgcaggaattgctgcggcatgcaaaagcctgggccatgatactgcgtgacgacgggaaggttatctgggaagagggccttccggaggatcttccgcgccaatattccgtaacggatgtcgctctcttcagccggtggtaccttaacgattaccccatccatatctggaaacggacagacgggcttctggtcataggctttcctcccggaagtgtcatccagttttattcttccacgcagagccggtatgccctgccctccttaaccgggatagcggtcattttcgttattaacatccttttaatgatatatctgtttttacggaatgtccgccggatagaacgagcaatcgagcccattttagaaggcattcattctctctcgcagggaaaggccttccggctggaggaaaaaggcgatctggcggaaatcaacgccagcctgaaccggacaggggaatatctgataaaaaaagacaatacccgggcagagtggatacgtggagtgtcccatgatatccggacacccctttccatgatcctgggttatgccagtgaaatggaagatactccgtccctgccgcagacaacaagaaaacaggccggaataatccggacgcagggtgaaaagctgaccgaattagtgaccgacctgaatctgacaacgaaattagagtattccctgcagccaatcaaaaagcagccggttaacccggtggaattggcaaggcaggtcgtaagcgactttcttaacaacggcttaggagaagcctgtgaactggagatctctgaaggacatcccggaaaagcgattcttctgtatgcggacgatgccttactgcgccgcatgctgagcaatctgatacgcaacagtatcctgcacaatgcggagggctgcagaataactgttttgatcggatcgacagataactgctgcacctttactgtctccgacaccggaacaggactgtccgaatctcaattacagtccctgaacagcggccatgcaataccaagtacctgtaaggaaacgaataatgccgatcacgggctgggcctgaagataatcaggcaaattgtgaaggtgcatcagggggaaatccatttttccaacaactcccctcatgggttatgtgttgaaatcaggatcacgcgatatgcataacctcaatcaaaaggaaccataccaaaccataataagtaatgaccgccactaggtcgttcagggttgtgatcaacggcccggaggccaccgccggatcaattttgattttcttgaagaaaataggtaccactgtcccgatcaggctggaaataacaagtgcaagaaccagcgccagcccgatacatacggatattccaaaagagaactgccatgtcgcatgctgcgaaaaatggatatagaaaccaataaacaccaccgacaggctcccgagaagcaaaccattggttaagccgatacgcccttccttaaaaactaaccgggccttctgctttccggtcaggttttcgtccatcaggacacgaatcgtgaccgccagagactgtgttcccacattaccggacatatccagaatcagtgactggaaaaagacagcgattgtgatctgcgccataaccgcctcaaacagacccacaaccgatgaaaccaccaggccaaggccaagcaggatgacgagccagggaagtctctttttaacactctccttcagaggctccgccagatcctcctccgccgacagacctgctaatttggcgtaatcctcgcccatctcgtcatcaaccaccttgatgatatcctgggccgtaatgataccaagaagcttgttttcttcatccaactcagggatagagtcctctgaataatccttaatccgctcaatacagtcatcgatctcctctttggcgtaaacaaagggataggatgtaatgatcaaatcctccagcgggctgccttcccgcgcgacaatcagatccttgagtacaatggccccgcgaaatatattgttatcatccacaacatacagcgtcgcgatattatcgtgatcggccgcctgccgtatcagttccttcatagcctgttttatggataaatctgcatgaagggcaatgaaattggtggtcattttactgccgatctgatcctcatcaaaagatgaaatcagcgcgatgtccttttttacgtcatcgccgagcagctcaatcagagtctcccgttcttttttctccagctgttccagaagcaagacagccttatccgcatccattttggtaagtacggccaccttctttttaatatccatctcttccaggtagcccgaaacggcgctttcttcggcatactcgataacatcagacagatcgtcaacatcaagaatccgataaaggcgctgcctttcggaaacactcatatctgaaagggccgccgcaatgctgttctcatggtaagccataagcttatccttcatgaccggcggcgtatcatttcccctgataatccggatgatctccctttcgtaattcggcatttcccctgtttgcacattggtcaacatttccgtatttggcatcatattttcctccttgttgaaaaattacccgcttcactcccaacacaggcggacgctccaaaatgccagccggaactgtcataatacttcggtgccgctattcagtgttggggctgcgactgttatcatccgacgtacttcgtccgggatccatgctgcccacctcttttctatattaaaataacagtatctgccgccgcccgccatactatgcaggctgctcatacgattccaaacagtagcccaatcaggcggacaactcctgccgcaagccatgcgatcgcacactgcccgaccacaacgacaacagcccattttccgcccagctccctcttaatcgatgccacagccgcaacacatggcgtataaagcagacagaagaccagcaatgccatagctgtgagcggcgttaaaagccccatgagcatttcctgggaagggattaaaatggacagagtggaaacaacgctttcctttgccataaacccggtgatcaatgcggtggaaatcctccagtctccaaagcccaggggcctgaatatcggcgcgataacgcctgctgccgaagcaagcatactgttttgggaatccgtcaccatattaaaacggaaatcaaaggtctgcagaaaccagataatgatagtggcgataaatatcaccgtaaaagccctctgcaggaaatccttcgccttttcccacaaaagctgcaccacattcttcgctccgggcatacggtaattaggcagctccatgacaaacggcaccgcctcgcctttaaagagactccccttcagcacaaaagccgtcaggatgctgaccaggatcccgataaaatacagaccgaccatgaccaaagccccgtgcttcggaaagaaggcggcggtaaaaaacgcgtagatgggaagctttgcggaacagctcataaagggtgtcagtaaaatcgtcattttacgatcccgttccgaagcgagcgtccggcaggccatgacgctgggtaccgtgcacccgaacccgatcagcatcggcacgatactgcggccggacaggccgattttccgcaggagcttatccatgacgaaggccactctcgccatatagccgctgtcctccagaatcgagaggaagaagaacagagtgacgatgatcggcagaaagctgagtacactgcccacacccgtaaaaattccgtccacaatgagcgactgcagtgcagcgttcacatggcctgctgtcagcgccgcgtcggtgacatccgtcagccaggtgattcccatgtccagcagatcggaaagccatgcgccgatcacattgaaggtcagccagaatacaagccccataattgcgataaataccgggattgccgtatattttccggtaaggatcctgtctatccttgtgcttctggcatgctccctgctctcctgcggcttaaccaccgtttgcccgcaaacctcctggataaaatgaaacctcatatccgcgatggccgccgcccggtccagactgcactccaattccatctgaagaatgatatgttccagcatctctttttcattatcctgcagttcaagggcttccagaatcacctgatcaccctccgccagcttggaagccgcgaaacggagaggaatgcccgcgcgctgcgcatgatcctcaatcagatgcatgatagcgtggatacatctatgtactgcgcttctttcatcatccgcactgcagaaatccacctgtcggggacgttcctgatatttcgccagatgcagggcatggtcaatcagctcatcaatcccttcgttttttgccgcggaaatcggaaccaccggcaccccgagcaattcttccatttcgttgatgcggatggaaccgccattctcccgcacttcatccatcatattgagcgcgaccaccatcggaacatccagctccatcagctgcattgtcaggtacagattccgttcaatgttggacgcatccacgatgttgataattcccttcggcttttcccgcaggataaattcccttgtcaccatttcctcactgctgtaaggggacatggaataaatacccggcagatcggtgatcagtgtgttggaatgccccttaatcgcaccgtccttccgatccacggtgacacccgggaaattacccacatgctggttcgatcccgtaagccggttaaacaacgttgtctttccgctgttttgatttcccgctaaagcaaaggtcagtatttctccctccggcagcggatgctcctcttttttctcatgatattttccgccttctcccagacccggatgagaaatatcacgctttggcttatgcgcgccgccttctccggaatgaatcgcagcctcctttatttctatcttttccgcgtccgcgacccggagcgtcagctcatatccatggattttcagttccagcggatcccccatcggcgcaaattttaccatggtcacttccgcgcccgggatcagtcccatatccaaaaagtgctgacgcagcgcgccctctccgcctacggaaagaataaccgcattttttccaattcccaattcttttaatgtcattgtaaccacttcctctcattttagtggaaaacacgtatcctgcttctgatatcagataaactgaaacagatatctttgtacgttagcaaaagctaacctatgatgaaaaaaacagatgccgcgctctgcgggcattctttcttttttcataaacaggggattatcctccccccggcacccggccggtcagcacatactcacctgcgctccgaatcaggacatccagcgccaaatcgtactgcctgccgcaatcctctttatgtatcagcgagtaagcaaggatgtggatcagagatgacagcacatcatccggcactttgatttctatacccgaacccttgagtgcatttcgtatatggacatcgtggctgtgatagtgcttatccagaatttcctgcggcattttcatcaggatgacagggacatcctcctggaaaaaacgcatcagttcaatctcatccatataacggatagcgcttcgcatagcctgtaccagacgctcctgcggcggcaggccgcttgactccagaagagacttattcatattttccgcgagatccgagtgcatatcctccatgatctcgaaaaagagcagctccttggaatcgtaaaacttataaaaggcgctctgtgaaatcccggccgccttcgccaggtcgccgatagtgattttctgcatggaggtatgtacgacggtccggcgggcgtagtccttcagttttcggcgtatcccgatcatctcacgctctgtaaatttaatggccatgattcatcctcgtgaaaataaaaaaataaaatgtttttacgttctttatattgtcacactttgatttggttgtcaaggtggtacggaagattttacattagggcccacagacgaatcctgcagataacaaaagcggaagaaaagtataaaccattcctccgcccagacattactttttatttcttatacatccatgagttcaataattgtataaattcctgcattttttacttccagtgtctgctgtctgtatgaaacctccaacagtggattttccgggaaagtactgatacatcccagcctccacgtttttcccagacggaaacagagttccggcagattccttatcctgtggctgtcactgtcataactgtaattgatgatatgcagtgcccttccatttcctgtgtcatgccaggcaatcccatatccatcttcctccggcgcagtgatttcctgttcacggcattccagcattttaatcagcgcatccatattttcttcctcaaaatgtctgtccgccctgaatccgttctcaggctcttgccccactgtaatcacttgtcccccaccgttctggtagcttctgagcaattttatatcctcctgacgcatggcaaaggcatccggcaggagcaccatgccgaaagaactgagccgctcataacacagcggttcatcagggctttcatagatcacccggtatagaatatgtctgtcgctcagcttctgcagcagccggaaaaagccgtcaaattccccatccccggcaaaagcgccttcagctcccaattcctcaggcagttccccgtttccatagactccctgccatcctgccgggggctttgtccactgattttcactggcggactgccaatcgtaaataacagccaaatccgctgcaggattcatgggaaaagccgcttcatgttcatccagccatggtccaagctttttcagcatacgaagatccggccacagtgcatcctttacctgattctgcagccaggaaccataggggaaagccagatggaacccatgtgccaggggctcaaggagaaaaaggataaacctgtcattgataccattcttcacatcttctgccatatcccgtacatactgattgggatcctccacaaaacagcattcctttccgttcagccatccaaatgcgaactgataccagccatcctggcgcagagagatgttagtcttttccccagccaggatatccagatgcttcttgcagtcccagctatggggataacaattgaacaggttggcgctcacggggaactcctcgtcccgctgtctgcgcgcataggcttttgcatgcttcgccacttcccgtaccacatattctatggagtccatctgcatccgggcatattcccgaaacaaaggaatttcccaacgttggttcccttttcccgccaccaggtctctgtccccatatcccttttgcagcagataggcccgatagtcaaattctttcaactctcctgcatccgcaggcaaagatatcctcttttctctgagatatcttctgaatttatccacgcattccggacagaaacagcctgcattattgaacacatgcttctgagaatcatactcatcaatatgcagaccgccggcatttgcatcaatcatcatttctgtttcttttttcagataggcaagataagagtctttattcgcgcatgccgaatagcatttatgatcatgctccggagccatcagccatcgtgccaggatattcctgccttccagggaaacagccttaaattcttcaaggtaatccccaactttatctcctttgaaatcagtaagcccctgcggaaaaaattgctctataggaggaaatacatagggataacggttgacggacaattcactcatacccacgtatccctttttcacaccggcatccctgtgtatattcaaagccagcagctgtgtttcatcttcattccattctgccgcaaattcccatagctgtgccttccagagcactgcaaacggccgtattccccttttccgacattccccgcaaaattccctgtcattcatatagccgtacagccgcattctgggttcagctgccccttccgcttccaaagccagataaggaaggccgatggcaccgcttcccaaacaggaccagagcagcatattaccatgcatttctatgatatcctcaatcatatgcatatttttcatcggcagactgggatgataattccacatatccctctgccaccccataaaatacagtccctttttcatttttctatacctttcttaatcagcacaatgccgcagactgactgtatccacggcactgcattttccttattcttttctttcggcggactgttcccttctggcagttactactgccttttcctgcagaagtcttcaaaatcccttacacaatatcgcatccctctttaagccggcacaccagattataaaggaaactccttatctccctgatatccttcttttccgctctccggtaggcagcaatcctggcggtaggcggtactgccatgggcaccagttcccctgcttccagcaggttagctacattttccgcagcctccagcagctcctccgctcctgcccttttctccaatgcatcccgggcggcggcgatcgccttatctgcatggccttcctggttcacatccgactgtatggctgtttcattccgatttctgaagaatcccaggatggctgccacaatagaaggatcccgtaccgttccgtccggatatactataccatgtaccttgctccacataccgccttcttcctctatcatcagttcaaataaataccagccaatcccatatctgtctgctgtctccactgccatatcatagggattggagcggcacagacagcccgtttcgttgttaattaccggcttgccgtatttttgagataactccaccgcccgcctgcaggttccttccacccggcttctggtttccagataatcatgaaaaataataatatctaccagttcccctgtcttgctgtactccgtatcctcaatgaatgtatgtcccacgccaagtgcatttaccgggtccttttctctaacaaatttgataaaatgccgcacaaaatcccataccatatccaatcttttctgtttttcctgcggatcatccacactcagaaggaaaccatgccagctgggctcgttcatcacatcccagaacagcaggccgggatgggaagctactgcattaatgatatcagacacatatgcttcccctatgctgtagttttccgggtaatagcacccgggaatgggagaacaggaatgatcctccgacagccagtaaggtgtctggtcatccgtaaaatagggcatcagcaggattggcgtagtggtgattccgtgatcatatgcaacagtcatgaaatccctgagattatcaaggaacctttcggaatcctttttccagtcctccatgtgcatgaacaggcggcagctgttgagcgtaaggcgctttgcatatcccatgttccgcacttcaatctcgtgattatagtccttgagtgaagccagagaatagttaaatcctttaatattgctgtaatcttttaatggtctcataaaccctcccaattttttatgcggttccgccgcccttgttcctgtcacatcagattcattccttcaatatatcaatagtccgctccgacatcttttatttcatcatatgccgccttcttctccgcatatttggaatcagcccactgatccagtttatctgctcccatactcttggcagttgacagcatttcctgatacagggctttggattcctccggcgtggaagccgtaataatctgtgcagtcatgttattataaagttccaccagattattcataattgtctgttcttccgaatctgcacccatacgaagcatgcccagtaccgggtttgtttcagagatggaagtggctgcttctcttgctttaaaggtctgtccttcattgccatatccgggaagtgtgtttctgacgccatcatgatagatccagccccagaatttcataccgtctgattcggtaggagattcaaaatcatagttcaggacaggatagctgtgttcttcatcccagttccaatcggttccttcctcaccccaaagagacaggcactgtccttcttcactgtacatgaatttcataaaattataggcggcaacaggatccgaacagctcttgggtacaaacaatcctctccagccagccgttgtctgcagatgctttgcacccggctgattagaaatgatatcggtcagctgaacaagtctgtagtcacagcctgcttctcccagagtcacacccatctcatcagcagtattggaatatttcgccagcgcaaacagtttgcctgctgccatgtaatctgaatcgtcgctgtcggaagtaaatgcaaaattctcatctgtcatataacctttgagataccagtcgttcatcagttcataataatcttccaggacaggatcctctataaatgcctttgcatgcccgtccacatccaggaaaccgccgattccggcatcggaccccaacagcattttaatgatgccgtttgtatgtgtgtaattatacataaagggaaccacatccggatactgtttctttacttcagccagcattgcttcaaactcatccagattgttgatctcaggagaaccgatcgcttcatagatatcatcgcgaactaccagacctgtggtttcataaacagccttcggatattcttccatataatagtccggagaataaccgcacataatggtatacaggtttccatcatcagccgtattcaccaatctcaatacgggatgcacatcaaaagattcttcacctgccatctgcgccagttcatccagtgtataacacatatcggaattctgcagtctggatattttcgcattgtcactggtaagaatgatatctcccaaatctccggaggcgatcatcagattcaatgccgtgctgtccgctgctgtagtcacctcaaaggtcacacctgtgttttcactgattttttcaggaattctgccttcccatacagtataaggccaccatgtttcatcattgaaaaacctcagttttacaatgtccgaactgtccgcttttgcagtttctcctgactgcgctgccgcagtcgtctgttccgctgcgctctcttcttttgggactgtttcattgctgccggaagaagctgcactgccgccgcacgctgtcagtaacattgccgatgccagaccaatgctgataaaagattttattccttttcttttcatagtaccctccttatatgtttggtgtttttattaaaagactccccggagtctgataaccgctgaattttccaaatatctttactccttgactgctccgagcatcaatccttgtacaaaatatttctgcaggaacggataaacacacatgataggcagcatgctggtaaccatggcagtagcctgtgtcgtcagagtagtcgactttgtagtgatagtaccgcctgtaatggatgctccggtagactggttgatttctaccagcattcggtaagctaccgtccgcagggattctttattgacgtaataagaagaatcaagccatgaattccactggttcacggcagaaaataaagacaatgttgcgatgaatggtgtggaaataggcattacgattcgaatcagagtcttcaattccgaagccccgtccagcttggcggactccaacaatgccattggaatggaaccgaaaaagttcatgcccacgataataaaaaacaggttcagcatggatggaattacaaacacccaaaaggtatttaccaaatgaagatttttcaggacaatataatagggaattaagccgccggatacatacatggcaaacactaccaggaaacggtatatcttaccgaacatcagatctttacgcgacagagtatagcttaccaggcaggtcatacatactgtcagaaaagtcccaacgatggtacggataaaagacaccacaaaggcgtttgtccaaatcttctgtcccagcagatttttatagttatcaagggtaaaaatacggggccacagatatacaccacccctcatgaaatcataaccatcgctgaaggatgccactaccacataccagaagggataagccgttatcagcaggacaatgatcagacagaaccagacaactatatccacagccaaatcctctcgggatcttatttttcttttattcatctgcttactttctctcatcagaatattccctccccggtaatcttcttcgccaccttattactcgccaggatcaatatcactgaaacggcggactgcaccagatctgcagccgttgcgtatgcaaagcggccttctgacaatcccattttaaaggcataggtctgcagaatttcggctgctgaattattaatggcatttccgaaaatatagctctgatcaaaattggaaccgcccattccgcctcccagcaggccgccgatggaaagaatcagtactgtcacgacggatcccttgattccagggaaagtgatataacgtatccgctgcagcctgcccgccccgtcaatctgtgccgcttcatagagctgggaatcaatgccgctgatcgcagccaggaagatgattgcccagtaaccggtggtcttccagattgctaaaaaggtagctactccccagaacaaattcggtgaagtcaggaactgaataggtgctttaatgaggccccagtcctgcagtatctggttgatcaggcccatatctgcattcaggaaagagtttgcaatggtataaactaaaatccatgatataaaattcggcagataggtaactgtctgaactgcctttttaaatttctgtaccttcatctcatttaaaagcagagccagaataatcggtgcagggaaagtaaagagcagtttcaggatactcagtaccaccgtatttcgaagaatctcactgaaacgataataagaaaacagttctttaaaccatctgattcccacccagtctgccgtccagatccctgaaaagcccatttgaatcttataatccttaaaagcaataataataccgctcaatggcagataagaaaaaacaaataaaaccgccataccgatccaggcaaatatctgtaattctctttgttttttgaatgttttccagcttatttgtaatttttccttcaatttcattcctcctgtcctgttctattcgttcttctgccgtagaataaaaagccggcacaaacgtgccggcgcatttgtgatgcctttataataaaacaactgggtaaaaaaaacttttgaatattagacttcttatttttgaaaatcagacctgctgtggaagaatgagttccacctgtgccccttctgtggggagattcgtaaaatgatatccgtaggcagacccatacaataatttcattcgggacaatacattatgtatcccgatatgctccccgcgtgcatccgccgatactgttccggatatattgagttcttccagcattgtttccgggaatcccggaccgctgtcactaatccgaagcgtgagtacattgtccctgtattctgcctccaggcgtattctcaaggtatcttccctggacaaagcatacttgaccgcattttccacaaatgtctgcaaaagaagcggcggcacagaaatctgcatgatctcttctgtaaacccttcctcttccatctttatttcatagggaaaccggatcctctgaatttccagataattatgagtaaattccagctcctgcaaaagcggtaccagtggtttttctacagacagaacgtaccgcacatgtttgatcagctccaatgttatagttcgaatctgagccacatttccggaagctgcaagagaatagataacattgagcatattaaggaaaaaatgaggatttttctgaatctgcagatatttcagaaaggtttcctgctcttccagccttttctcatagttctcaatcttcatatcgtgaatttggcctgtcatttcattaaaagtgcccgaaagctcccgtacctcctgacagcctacaagttttgttatatgagtatccagatttccttcggaaaaggttttcatctgtcggtttaattcggaaagcggtgcgaaaagaactctctgcagtgtcagaagcagataaaccaaaaacaaaccgcttaaaacagccagaacaataagtcctgtccaccatatcatccagtttccccgcagctgctgcctgggtaccagcgtcacaatagctgccggaaaaccgtcgattttttcggtcagctgcagataacgtcttccctcctcccaatatgaggaactctccagtccgaaggtgcgctccttatctcccgttaattcatatccatccctatcggtcagaccggattcctcaaacccggccactccttctaaatcaataatccggttccatatcccgtccagagacacatatactcccagatactgtccctggtggtaatagatatagaaggcagtccacttattgtcaatattttcaattgtccactctcctatcgcccgttcctgctcctctcctatacaaagtgttttcatgcgcgtgcgtatttccatccgcctggtcacataagtcatggaataagcggaaatatcattccattgcttattgatgagaatatctcttgatggctcatagaaaaatataccactgaaatcaggaaaatactggccataggaatccatctgccgagccacctgccgcaggttgtccgcatagctgagagaagtgttgcggagcatgccaaacttgtcatcggaaaccaatgttacagtcagaaaattttcaatctgcctaagcctactctccaacttggaggaaccaaaatccagcactccctgcatagattccctgctttgccgatccaatgcaaacatagtaactgtacttaccgtaataaacatgatccatagaaccagcaaaatagctccaattgcaaaccatatgtcgcgcaaacgccatcttctccgaattcctccactggcttttctcattgcgaatgctcctttctccaggccgctggtgtcaatcccgtacgatttttgaaaaaagtggtaaaggaagaaaaatttacataccccaccatctctcctatttccccaacaaagaaattagtctgttccaacagttcacacgccatctgtacttttgcatcagcaatatattccttcagagaaactcccgtttcttttttaaaaatccgattcagataatccggatgcagtcccacgtatgccgctacttcctcacggcaaagctcctgctgcatattcatggaaatatacaatttaaccctctgtataatggattccggcatcgtttcatggcgctcctccttaatacaggcaaacatcctctcataatattccaacagacccggaacagttctggtataagccggattttccttaaaaagctgaacctggattttacgaaacctctctttcgcatctgcctccagcttccgttcaaattcctgatccattctgcgtatggcggcatcaagagaagccgtattacactgttccggggcaagcgccagaaaataatccttcatcttctgcagcagttccgtatatttcccggcagtaaacaggccggaaaaacagctcttcataacgtttggcagttcaaacggcatgaaatgagtatgccgtacctgggaagcagtataaatcccgggacttaccgcaaactgagcatccgcctgccgcagcagttcacattccttctcccatccagtcaaaaactgtatctgtccaaaatagcaggaaagtgcacaatgataattttcttccatccagtcagacacctgcagaagcggttgaaaaggatcctttgaaggattttccggaaaaaacagccaaagcctttcatcatacttattgaccaacgcatacctttctccgcgaagtacctcccggagcacattttccaaaataaatgacattagggaaggatttatgtcccgaattttataggaatggtgctttactgttacatatacaggaaggaagcgaagctgttcctttacctcatactcttcacagacacgcctgagcttctcaccacagctgatatgatgagccataagtgtttcccaaaaggcatccatattccgtatcttctgttcctgcgttttccgttctttttctctttttctatattccactactttttcttctgcatcaaggatcgctttcttgagttcctcctcttcagccggtttcaacaaataattactgcacccaagctgcagggcccgctgggcatactgaaactccgaatgacaggtcagaaggagcgttacaacaggggcgggaacttcttcctgcatccattcgatcaattctattccggtgcccataggcatttcaatatcgcaaagcagaatatcaatctgttcctcctccagaattttttttgcctgtttgattgaccaggcagtccggatctctgtgattccccagtctacccatggaaaggagccgggcatgctgttaatgataattttgtcatcatctaccaataataatttcattcattcttcccctgtccgcagcaatttttttccctgctgttaaaaaactgattgtgttctatactctgtatatccttcgaaactcactctctgtaataaatggtcttaaataatcaaaggcacgtcacttacggttttttcgttttgtttcttgatcatatcatattttagtaagaaaaaccacttttcgcaagaatatccgttcaaaattagacattatgtatataacaccgcttttaaaagggaaaaatgagaaatatcgaaatagagaaacagacagggccgccactcatcaagtgacggccctgtctgctatttaaataaccggttcagcttcctggaatgtaagtgattcaaaaataattttcccatcccgaatccgctgtgtcagtatgccgcattgctttttcgccctgtgctggaaaccgatacagctcaattccgcaaccgcttcttttactgtaatctttgcggcaggatcggttaacgcatctattttctcaccggctctttgaatcaatcccccgcagtaacggcggatatcctcttttccttccagcggacgctcacacaggttcgtaaggatgatcgcatcatcggcatagccggcaatcagcgcttctatattatgctctttcaaattggcaaaatgcctgtccgttaccgccatcgcctccgcattgcttgggaacggatgcgctttcacgcccagggacggcatattgaccgctgttttggcaaagccgctcacataaaccgcttttccgttttctaccatgtatgtgaaagaagcgaagggagaaaaaggcggcatagaggccacaagagtgatataattttctgtactttggcggtacaggaaattaagcttctcaactgcattttctatatccatccccagcttgactgcaaaggaaagggaggtacgcataacactggtaagggtatcgtgccccatggtacgggttcggccgtccaaacgggtaattgcaaccaattcatcggaatagtctgacagcgcttcatccagattcgaatcctttttcatactcatcatggaattaatatgatgtgtcatcagttcttcagctgttcttgtcatttttatctctccttaacttttgtctgaatttggcctttgcgtgtattattacactcgtgtataataactataaatcacgcttcttttataagcaatgaccagattcaggaatccatgtagtaatacacatttttcaaaatatgtgtattaaagagggagttaaccgtaatatgacagaccgtagaattgttaaatcagaaaaagcaatccaatcagcctttttggctatgctgcttgacgtcggattcgatgccattaccgtgaagggcctgacagaaaaagccgatatcagccggaagaccttttatctgcattatctggataaatatgatcttctgaacgggattgtggatgaaatgattagggagcttactgacctttgcgaaaagaagaaggacatggggtttgtggatggcactgtcctttggttttactattttgaagagcataaacccttctttacagccttgttttctacggaaagtaccatctccttccggcaccgcctgctggattttatcatggagcaactgaataataagctggaaggagtctcggaacacagggataccgaagtcctgtgtaaatttatggcaatggccgtacttggggttattgaatcctatgtactggatcaatttcatgttgggattgaagaaatagcgatgcaggtaggggaattgctggagcagattattatacaggcgaagggggaataagccggtttcattcttccagcggattttccaaggctattctgcgcataacctcaataaacttttccggttcttccatattcggagaatgagccgaatcctcaaataaaataaactccttttttggtgcctcacaggcctctgcatatttttctgccagaacttgagaaaccatataatcatgagccccctgagttatatagaagggaacttcaaattttacggatgataggaaaagatcatcttccagtaaatcggggaacaaatgtatcatcgaaaaatcagcgccaagaaaccagtttattttttcggtaacggtatagcccttgaacacaaagagtgatttaagtatatcccaggaagtaaccccctgatgtaaatgcccgattccgtatttattgagaatagctgtcctgccttttacgagataatcgagctgcggaaaatcatctgcatacgggtcatatttttccaacttttctataacatctttgtcattcatttgctttgcccggctgagaatatattggtaggctaatcgctccgattccttctgattggatacctgtccgataccaatatacgcaagataattcttcggatatttttctatagtcttaacacccaggtatgagccccaggaatgacccagaagatatattttattctgaccaaaacgtgatttgagatattcggtaacttcgcgggtatcctcgaccagttgatctaccgtcatggtggtgggatccgttgatttatcatatgtcattcccgccccgcgctgatcccaatagcaaacggtaaaatacctttcaaggcgctcttctttttccagataggaaataaattgaaaaagcggcgtaccgggtcccccatgcaggtacaggagcactggattatgtatatcctccccgcggataaacattccctgcttaattccgttgatatcgatccataccttttcggaaacagaacctggaattatatttccctgtgtatcctttaacggcgtaagcctgcccgggctgttaagaaatgccgccattataaacatggaaacaaaaataataaatataaataataaaataaacatttttctccttaatcgactcatatctgcctgccgccccttttattttttctgctaatcatctcctgctgttactattctttttatccgcaaacttcttttatgcgtccagatatccgagtatagcctttgccaaaatctgaaacattacattaatttcttccgaaatgtcatcgccttccattacgccggttgccgtactttgcgcgatgccatctataaaactgcttacaaacatgattagggaccggacagggatttgcgggtgaaaaacacctttttccacattggccatggtatattccacaattttattctgcgcatattcaaggctttgtttaaacttcagtttagggaataccgcagcccttttttccaaatcgtaggcatagtaaacaattaattcaaaacaggttctgcctccgacggatttcagaagctctcctatatacctgcctattgcaataatacattcggagaggatttctttttcctcccgctgcgagttcagtaatgtgtcaatgtcctgttccaataaattataggttgtatttttgttgatataatcaacatagatgtcatctaaaccggcatagtaatgataaatgattccctggctgaaaccggctcttttgatgatgtcacgcatggttatggaatatagcggcttttcctttaatatttcaccggtacattcaaggatgtaattttttttatctgtaagatattcgtctgtgactttcggcatatgcagtcctcttttcaaaattgacatagtgtcaatttatagtttaaaggaaacacaccttattgtcaaccgcaaaaatgatatggtgtcaattttattcatgaaaaagccgctccccgtatctgattgctcagatgggtagcggctttttcccgaaatataacattaatctttagaaaattattgaatacggaaagcaatcgaatacagcagtcagacgttcaaacggaggcaagggcagaaaatcttcctctgctccatctatctttggaatgtccgcccgtgccatgtccatccatatcagcggttcattttccccagattctcattaagtatggaaaggactctgtccatacactctgcagcctcttttatcttagccgcgatcctgacacgcctgctttcatcctgcagattctgcagtgtaacattaaagccgccgccaagggcttctaaatcattgccgttatcattattccatatctgtgccgttctttcgtataacctgataacctcatcaagaaaagtcagatcaggattcagttccataactcttctgaaaaaagcagaggaacagctgccattcgtagccatattacagatattgctcacatgtaccgcccagccatcgtcgaattcttcgggcttcatgctgtcaagctttccgttttcaatgccttccgcccacgcccggaatgcctccgggccgaagcagtattcctcatttttaacagtgagcagtttaggcatatcaaaaataatatctctgtatagctgtctgaggctgaccttccttttcttttcgccgatgaaaaaccatccttttgcggtactcgggcattcctcattggaatcaatgatccggtcaaccggaattcgttcaggctccatcctgtctcccgtcagaaacagcaatattttcccatattcttcatatcccacatatactcccatgggaggtccgccgtatgtgaaggttatgacaggcacccccttatcgatatatgcgatcagcgtctgaatatacatttccttattggcagcgagctgctgcgcggctacaaaggttcctgcatagccgcatttttcaaaaattctttcgaaataactgcctccctcacgaacagcgctgcaggtagacaccccttcccccatatatataccgtaggaataaacctgtgccaggacatcacctgtaagtcccgcgaaaaagcaataaccgaagtccggttccccggtatattctcccacgctttccatcacatacctcgcacagccgtcgaaccagtaattttctccatactcactggtaattaatctgtgtatatcaggtatcatattgttgctttgcttcgtaatcataataagtgccccctcttttattttagccttaggctgctgtataagctgtgatacacggatggatcgaaaatacttttttatagaactattggaaccaataacgacaggaagtgccttctgacagcttaaatccgccgacatataagggaaatcaacaccgcagtacctgatttcatcattaatgatcaccgcaaaatgcttcagtcccacaatccatgtcagccggttatagactcccggcctgattccgccgcgtttggggtatctgtggtaatccccgaaaaccggctgatggaaacagatcgcctcctgggataatctctcatcgggattattatccatattaatcccaaacatataattcaaatcttcaccatgatggaaacgaatgctcccttcattcatcccatggccgtatcctccgctgtcttcacccacccgaaattccatatccacccgaaaaggaatcttcacatccacgccagtggacaatacccttgtagatatccaggaaatatattccgcctctccctgttccgtaacacggtaaaaggggctgttaataggaatcagcttgtccatggggacttcttcagaccacaagacaggatttgctttttcgatctcctccacggtaacagaactgcactccagttcttccggccttccgaacagttcggaagaagccagccttttctttatgggtatgagcagggcaacgagctccctcttttcatcaggcgaaattaaattttcaagcatcgcttcctgccgcaaaccgccgccgtgaacataatcgacttcataatatttattgtcatcaaaaaaggataccagggaacggagccgctctcctaaatcttcatcaagatagacatttaccgaagcaaacagtcctccttcgaatatgaagtccatatatttgctgtcatttacaaaatcgtcatccattttcagaaggtaaacgtcccccgcagccgtctgatattcaaactgctcatggctgccaggcccgcctgtcataatgcgccgtgactgcacccaatgccagaagccgtccggatcggtcacctgattgtcttctttcaggtatgatgacaggacacgcatggaaggcaggagcaaaatcgaaggctccacaggctttgccagattttctgagatcgcagacagttcgtcgtaggatacagagttattttcccgcgcatccacctgttccagttcctggttgcagaaggcttcataaaggagcggtaaggcggagatgttccggactccgttttttaacatcgttttcaaaaaatcatccgttacctgtctgagttccgtcagcgcggctgcttctctgtctatctcctctatgcggctgacaaacacctgcactaccacgctcatatcatcgctttcatatatgcgcaggatatctttgataggaaccatcattttcctaaggacaatgatctgcttcaggcgttcaatattggcggcgtcaaaatagcggtatttctcgccaggcaggcgcacactctgaattaaaccggcttcttcgtaataccgcaggctgcgtgaggtgagtccgagttgtggtgtgagatctgtgatcttgactaaatccataagaattccccccttcatctcatgtaagtatcatatcacttgacgctgcgtcaaagtcaatagaaagggaatttttcttatttaccaaatgatttctattgagtcggaagaacagggcaatgatggattagaggctgacaggcaaaatgccatacattataccactgaaatatggtctaatgtatggcatggtatttttttgataaagcataattttcagcacttaatctgcctgtgataccgatacgtataccttatcaaactgcagatttccaaacttattgatttactattctattatatgacaagcttttttcagcgttccaatcagttctgtcaggtagtcctcaatttccattgcatccacattctgctgtcttctgtaagctgcgatctttgcagtgggcggatatgccataggcaccagttcgccagcttccagcaaattagcggcgtattcacaaacttccagaagattttccacatcctggctgtgatctgagccctgattctgcctggccgcatgtaatgtcctctcagccaatatactgactctttttacataatcctcctgattcacatcggaacggatggcagtttcgcctctgttgcggaaaaaaccgcctattgccgctacaatggaaggatcccggacggttccatccggataaactactccgtgcacacgcgaccacatatccttgcctatcatcagttcgaacaaataccaccctatctggtattcatcatgcatctcaatagacatatcataggggttggctctggcaagacagcacatttcattgtctagtacgggcttaccatatttttcgcccatctttttcgcatactccagtgcatcgcgcatacgtttccgggttgggaaataatcgtggaacacgataacatcaacaagctcagctgtccggctgggttctgtttcgaaaataaaaatattgcctataccgatatcatgctcctgatctttgcttttcacatacctgcagaaatgtctgacaatctcccatgttttttcctgcctgtaacggagcagttccatattgggccgctcctgataatcctgtacataagaaggctcttcatcataccatgtcacaaaattatcggtatatcccggctcatttgcaatgtcccaaaacaagagaccttcctcatggccgatagcttcatacagatcgtcaaaatacttctcgcctatgtaccagcaggatggatcctccagcgttttatatatcggcttcaatccggcttccagcataaatccgctccatggaagttcatcctctcggaaccgaaatcccataaaaataattggattggttgaaataccatgtttccatgctgtttgcacaaaatctttcacattagctaaaaatctgtccggattttcgttataaaaatcataactgagaaaaatcctggcactgttcagatgaagcctctcagcatagcccatatcacgatcaactatatcatgatggtactccgcccagaaaaccctgtcatttgcagcatccggctgtgtgtaattaaatccgcgcagcttctgataatcaactgtttttttcatgaatccccctaactatgcgcttcagcgcgcatcactcatcacccctttattccgccgagggtgattcctttaacaaaattattttgtacaaaaggataaattatgagtaccggaagtacccccgcaattgccatagccatacgtaccgaaaccgtaggcaggtctgccagcagagcagcagcatttgaatcgctggactgggtcagatattggatattctgcacaatccggttcagcaggttttgtatggaaaacagatcctgacgcttattcaaatacacatacccattactccaatcattccagtaggctataccggaaaacaagccaatggtagcgataatcggctttgcaagcggaaccgctatcttcaaaaaggtctgagtctcggaggctccgtcaatatacgccgcttccattatctcatccgggatactggaggcaaaataggatttcataagcagaatgttgaatccattcgttaccagaccaggaatcagcaaggcccaaaaggtatcttttatatgaaaaacattgacgtaattaatataggtgggaaccagtcctccattaaacagcattgtgaaaaagatataaaatgtcataattcccttgccgggaatatcctttttggaaattgcatatgccatcagagtcgtaatacacaaggagagtactgtacctgcggctgtcagttcaaaggatatggcataagcctttataacctgcggattctctataaaaatgtatctataggccgccaggctgaatttctcaggaaaatagctgtagccgttccggatcagcgtattgttatccgtaaaagaggaaatgattaccaggagcaggggtgctactgccaatactgtcataattatcataacaacatttccaataaactgaaagcgtttttcgtcttttgatttcatatttatagtcccccttaaaataatgcactgtccggatctatttttcgaacgatcagattagcagacattacaaggataaatccgatgatcgactgataaacacctgcagctgttgccatgggcatatcgtttctttcaagcagtcccctgtatacatatgtatcaatcgtctgtgttacagataacaaaatgccgcttcgctgtggaacctggtagaacagaccaaaatccgaatagaaaatacgcccgattgcaagcagtaccatcatgataatagtagcccgaagcagaggcagtgtaattctggtaatctgctgccattttgaagccccgtcaatagccgatgcctcatatatttccctgtcaaagcccaaaatagtagaaagatatacaatacagctgtatcccacacttctccatgtttgcacgaacaccagaataaagggccagtatttcggctcgttataccaggaaaccgcttctatgccaaacaaagggaaaattccattattcagaaagccattttctgcacttaagaatgcaaataccagatagcttataattactgttgacaaaaagtgaggcagaagtatggttgactgataaagcttcttccatcttgttgtaagttcggagagaatgattgcaatcgcaaccgatattatcacattaaaaaatatgaagagaatattatagcccagtgtatttctcgtaataatccaggcgtcctgtgtcttaaataaatatttgaaatttttaaaaccgatccagggtgaaccccaaattccctttttagtggaatatttcttgaaagccagcaccagtccgggcaaaggcatataattattaataaacaaatagataaaccccggcagagccataatatacacaggaatatatcgtttggcaagctttaattttttctttggatcccttcttacatttgctgtctgtttcatagtatgccagcctttctttcgagaaaaaggaattggaatctaatcttccattcctttttctcatttttcagggaaagctgcctgaggcagatttcctgataaccatccttagattattcgataccattttctgccgcccattccttcaaggctgcagttttagcttccatataggtttcaagaccggcggcttccagccttttattaagttccggaatccccactgcgggatcaatcatgccaaacataaggctgttcgcatattcaacccacacattagtcaacgcagtatattctgcactcacttccgaagaatcaaagctgaatccaagcgctttggactttaaagccgtattattaaattcaatcgtcttttcccagagatcaatatcatcaccttcccagacataagtggtatactcacaaggcagagcccaggcaggaagcatattgtaatagtcagcattatccttatttaccccttccgggaaagcagcatgtccgtcatcagtaaggacataatcgatgccttcctcaccccaaaggagcagattcgttacaataggattggtatacagatcattcagaaccaccattgccgcctcaggagcctccgtattggaattgatgctccatgcagccgtggaggccgcttcaccgcgtacgaaattttctccaagctggaatgcgatagaatccagatcgccgcgctctacttccttctgacgtacaataccgggtttaccgccggtggtatcactcatcagagtgcctgcaattatctgtgccccgccgctttgtgtttcagtaaccgcatccttggatatatatcctgcctgctgccatgtatacatcagctcacaatattctttgaacatatcgcttgtaaacaaatcggatacttccagactgtttgccggatccaaaagcactccgaagttatcgccgccaattggatcatacagaaatttctggttcaggtattgataaccccatggataaattacattcacatccggataagcctcatgaagctttgcgaataattccgtcatatcttctgtagtagccggattacattcctccgtattgatatttgaaaaatcatatccaataccatccagatactgcctgtcaaatacgatacaccacatacctgttgccagatcacgcatgcaggggattccacacagggctccattaaccacacaacctttcaggaatacgggatcaatcaattctataatatccttgccatataaattgattaaatcatcctgataaagatcataagtactctcattggctaccgtattcgaaaatcccatcatacccgcacagaagatgtccaactgttcccctgatgaaagcatcatgttcatactctgtgcataatcagacataagcgcagtcacaaactgaacatcgatattataattctccatataatattcattgatcttttcaaaaattctgttctttcctgttacggaatcatcaccgcaatacagacctactacaattgtttccccgtcaaaatctttgattagactatcttccgtttcagctcccgaagactcctcacccacattttctgcagcaggcggcacagacgccgaaacatccttctgttctgtaccacctccgcatccggcaagaagccctgctgtaagtatggaacacatcataaacgcaagtatctttttcatggtaaaccctcctctttcgttagttatatgatatattaattataactgtttgcttgttggaaaaatattcacagggcttagctgttatttcaatattcttatctttcttccttatcagtacaggcagtaataatcctgaagctttcttgagacatcataggcaaatctcctgatttgtgcccggtcccgcttttcctcgggaatattcctcagttcaaacagcttagcggacagtaaatcatccatgggaacgatctcacagcattccagaatattgatacagacttccgcagcatccagaatttcatccgtcgttgattcaaacttggtaaacaggctttgtttatctactgcaagagcctttttcaccctctccactgctgccgtcgcatattcctctctgtttccctgaggaataattctctcgcttcctctgttcctgtagaatccaaacatcgcagcaacaatggaaggatcccgtacagtaccatccggatatataatcccatgaagaggtgcccaaaagccttcgattaccagattaaatatataataaccataatggaattcctcacagaactgcagttcaacatcatagggattagcccgcccgatacagcccgtctcattattaataaccggtttccctccctgagctgccgcacactttccggcgaactcataaacctcccttatatcctttcttgtggtgaggtaatcatgaaaagcaatgacatcaaccagatccgctgtggaatccagatgttccttcagctcatgtcctacggtaatgggtgtatcatcatccaactcccgtaccatctggcactgcagcctgagatcatgctcaatttttctgtatcgttcttcatattctccggcaggacagtttctcaaataatcattgcagaagggttcattatagacatcccacatcaacagattaggctcatttttgagtatgcggataacagaagagagataggcatgtttccgctcccattccttatcggtcagtaattcatagcttcgtatctggttgccgctggaaaaaataggcataacactgattccatgtacggcgcagagacgggtgtaatccaatatcttcttttccgccgcctcaggatccctgtgccattcctcctccccaattccaacacgtacagaattgatacgcagccgctgtgcatattcaagctctctgtccagctgttccataggaacgccttccctgggtccatgatgtacgccgcgtatctcactataatctgatttcactctgtctttccatattttcatatgttcctccaattccgaaaacaatctgctgttttttcattcaaatgcacgcagtaattcccttctatagtcacttgtcactctgcactctctgtccacgcgcacgatctgctgtgattcagaggtataacgaggccactccattcctggtatggagggatttcctgtgcgaacaaatgccgcccatgcattactctgtactctcgaagcattttcacagaagccataccttacaatcctgaactgaagggccagatccgatacatgccaggcataggacttggatgtatcaatggtatccggaacatccagtgcattataatatgcatatacaggagcacctcccacaactgctctttccatcgcatgataataagccccggaacccaaagagccctttaaagatatcacattccaataaatttgaaccggatccgtctggcccgtcaccctgcggaacgtatccacaatttgggttatctttccgatttcatatttatcttcaggaactgtccctaacctgcttgctgacagagcctgctgtaaacgaactgccagattctcctccgtgacaggagcacgatcttcctccgtcataaaagaagccatttcatcttctgaagatcctaccagaaccgtcttcagcctggcacagtcttcataagcaaacataggtactttctgtgttttcagatagatatcatcgggaaccggacgaaaagagtgaagaaatggttccgctgccctgaggatttcctgagaagaaaaatttttaagccggttcagttctttttctgtaatacctaaatttgcaagaaatttcctcgcattatccgttgcttcttccctgttgtcggcgcctacttttccagaaccgctttccacgatagcatagcgaaacaaatctttagccacaggcatatttaaaagatgacagattttcattgctccgccggattcccccaatatcgtaacctgatccggatttcctccgaatgctgctatattgtcttttacccactgcagccctaaaaccagatccaggatacctgtcattccggaagattcatattttttgtcaaaggcccctaaatacagataaccaaatacattcagacgatgatgaagatataccactactatatcctgctctttgacaaaagtatccgcaccgttcattaaaacccctgaccctgttgcaaaaccaccgccgtggatatatacgagcaccggcctggcggattgatcaagccctggtgtcataacaccggcaaccaggcaattttcacttctgacacacggcaaatccgttttctcctcaccagaccgatcatttccattccttacaccgaatctgtccggttcgcccgcagtaaagtaatcaggcagctctcctcccgctgttcccaattgtatagctgttgggccgttttgagtacagtccagtatgccttcccatggttccgctttcccggccggaagaaaacgcccgtccccttccaccgatttaccgtaggggatcccccgaaataaagctataccgtttcttccaatcccccgtacctttcctgaagtagtctccacaacaggaaaccgatcatttacagttccgaatacagcttctccatatcccatgttacctctctttccgccgccttggcgacttttggcaaaacggattattgtggtacataaccacgaaatccagattttaaaattgttgtgtccttccttgcttctattataaaaatacatttttcgaaaaactatgcacacatcttagataatgtttcaatattcttacatgttcgtcttagttaattgcttttcctaactaagaggattactatcatattgtcacatattttattacataagaagtcagacatatgcccgccgtttttcggcagaaggagggagccaatgcttttccacagacgggagtattcccttttttcccaattttctaagattattcttttaatatatggactttttgtcgtatccttttcactgatttttctgtttctgaaccacaatatgcagtctaatctatatgacagttattgcaggacaatagactactgtctgtcgggtattaaaaacgatttggaaatagctaaccgctcggttctgtcaaccctttataacaattcagatttatctgagctttcctgttcaaataatattctgaatatttctgtctgtgaatccagcctccagagaaccctgaattcctatctgctgtgctattcaacagtagacggactttttttttacagcggccgtaatgaccgatttatatccgccgtccgggataccaattccttttttcctgtctatttcaggaatatgatgaggtcagtcgagttttctgtttattaccgggagatacctgccaggaacggggattatgttttctgccaaattgacgggcggtactgccttgtccggatgtttacctataataatatgataggaggtgtgtgggttgacctggataccattatgaaaaaactggaacagagtacctccggagatactatctgtgcctttctcaatgactctgagatggatgatcctgttgttaatcggagtacagacaaagatgaactgaaacgaattcagggaaaaaattcacagattgtaacctgttcaggcagccggtatctgaaatttcttacacagccttctttctgctgtggagaactgctaattctgatgccttattcccaattacagcaaacattggatctgcattatatgctgcagggaattttcatcatcattctgactctttgtttcttttctactttccttttgtatagcagccggctgaaattgcctgtccgcgagttatacagaatctcggctgctgtaaaggacagctggcagccggaagccatcaaacagcagcaggtaagccgctgtaaggaagtacgcgaaatcaatgaagaagttatccggctcttggaacatatcaattctcttgaaaaccaggtattaaaggaacaacttttgaaaaaagaatatgaactgttaagtttgcgtaatcagatatccccccactttctcattaactgtctgagtgtaatttcatccatggcaggtacatctgtcagccggactgttctgaaatccatgatttctaccctggccagccatctccgctacactctgtctaccaaatcctttgtcagtctggcagaggaaatgtgtttcgtccgcaactattatgatttgaataattaccgctacccagacagcctgacctatcaaatcgatatcagagatctgtgcgacaatgcggcagttttcccttgtctgatcctgatgctgagtgaaaattccatcaaacataacttaagtgcagatgaaaagctgaaacttatcgtcacagcaagagaagaacaggatgagcatggaaaatcttatgtacatattactcatctggataccggaaatggtttccctgaacaaatgctggtggatttgaatcgccccaatccctccatcgaagaaatagctgatggtaccaggataggactgtacaatataaaaagacgtatactccttgcatacggagaatcccacggcagcatccgtttttcaaacaacccggaaagcggaggtgcacaggttgacattattattccctatattccttatcaggagtcctgagcggaaaataaaggaggcgctaaatgaaaatactgatcattgacgacgattactatatcgtggaggatatccgactgaatacagactgggaaaagttaggaatccgtgaacaatatacagctcacagcatacaggaagccagaaatgtgatggagcagcatcctgatatggatattgtacttaccgacatagagatgcctaaggaaaatggctttgattttatccattggttatatgaaaggaatctgaatcccgtaatccttctgcttaccggtcatgagcggtttgattatgcccactccgccatcgaactgcatctgctggactacctcaccaagccggtagatatctcctacatggaaaaagctctggcaaaagctgttggtgaaagcaaaagaagaaaagtctatcctgaattattcaaaattaatcgggatgaggaaaaaacggaaacaaccattgaaatcatccaggattgtgtcaggaaaaatctctcttcccctgagcttaaccgccagctgatcgctgaatttgtacatatgaatcccgactatatttctgctgttttcagcaagaaaaccggcgagtctctgacctgttttattctgaaggaacggctgaaagccgcaaaggtaatgttagccaccactgattattccctgcaggaaatcagctatcggacgggcttttctactccctcttattttcaaagacagtttaaaaaaagtgtgggaattactcctaaaaaatatcggatggatgaaaagagaaaataataggggagcaaaaaacttgcctatataatggggctgagaaaaaataaaaaattattttttctcagccccatatttaaaaccagttttttatatcaggattatgataatgtacctgtaattctgaaatatgataaatcagtacatcattttgataaaaaggctcttttttataaaattcccagactactttttcatcctcagccctaactacagtcacggaagtactcatatcgttttttaatgatgaaaaaagaactttcccttccttcatcaggccaccggtgtattcctggtgttccttcatcatgtcttccgtcatcttttccggatgggtgacgattccttctattaaaaaatatttcatatttctcttcgttcctccttaaaatccacttaaatcacacgccgcacaatgcgtctaaagccgccgtaacagtcaccggaaggcaaatcaggaaaacgcttattacgcgaacgtcagccagtcctcccgatggagctgaaaataatcaaactcacacattttaccattttcatcaggcactaaacggatcccatggtttgagaatccaagtttctctatcacacggcgtgaagctatattttcaggttttacaatcgccactaaaatatcctgcccggcttcttcaaaagcataacgtacagcagctttggctgcctcggctgcataaccattattacgatattcttcagctataccatagccaatttctacttcccggttcagttccggcttactatggatgtatacacgtccaatacattggtctgaatctttcagccagatataaaaattaacgataagcctgccttcttcatttttatcttttacccagcgaatccaatttcgtacatcttcatccgatgcaaattcatcttttccgaaagccctcactacctctgcatcctctcccgtaatggtgcgcagaaacaatctctctgtatataattccacaaaaacactctcctattcttactgtattttcagcagctcatccgcgatatcttctgtattcccgataagccgttttacctgtggaagccaataaaatgttgatgtattgtcatcgcatttaaagtaggtatcatcatggtgacatatgcagacctttttattcaatgctattgccataccgaattccgtatgggtacctctgccctggggagtcaatactattacaatatccgacttttttatcccttcatactctttttcgccaatagatttcagcgtctctacatctgttttttccactgggcagtttaatgtccagtcgtaagtatgctcccaaccggcatttttcagcaaatgtgaaagatcacgtacctgtttataatttttaagacttgaagcaatgtaaaatctcatttgtatctcctaattatccattcttccatttatctaatccgataaaaacgattaatctgctctacggacagctgcattgaaatgcattatccttctgctctgtataccacttctgctgtagttcatacatccgcttatattcaccttccacacgcagcaattcttcatgactgccatcttgtacgactttcccatccttcaatactatgattctatccgcaatctgtgcggaagccagcctgtgtgttactattattgcagtctttttttcacaaatccctgcaaaatcaagatacaatctcgtttcttccattggatctatagctgccgtaggttcatccaaaataatcagattactgtcacgataaagccccctcgcaatagctattctttgccattgccctccggatatctcaatcccatcaaaatcccggcctaaaaacgtatgcaaatcgattgtatcataaccttgcccgagattaactctgcactgcctgcataattcttttattctgctgtcattattctctttatcgatgtcactgatacagatattatcacgcagcgtcattttatattgacaatatttttgaaatacggcagatactccataagtccaactcactgaatttaccggaatattattataaaaaacggttccttcgcttggagagtagagtcccataatggttctgcataatgtagtcttcccacttccattttctccaacaatggcaactgtctgcctgtctcctattgtaaaattaatattatccagcgccttttttgaagagttaggataaacataactaataccatcaagtcttatacatacctcttccggaacagacattttttctttctttttaagcggtgaatcaatgaatgacataaaattctcaaccattacaatattttcagaagcccacccaaatctttctgaaacaacctcattaacgaagccatatattctatttattgatgccaatactgcagcaaaggcccctatagatattgaccggctcatgacagatatgaataacagataaattacagcaccataacatataacagtgattaaacttaaacagaactcaactatacttttataggattgagcctttatcgtcaaacgtcctaaatcggagagtactttgtgatatagctgttcaaaatagggaaccacacccaatatccggctctcttttaagtattctttatccgtcatgcacttttcaaaataaacagcttgtcttcttaacggaacagattcatcttccaattttctaaaggttatgatatttaataatttggaaactacggaagggacaaatatgataactatacttatccccaaaacaggtttcagcttaaaaagataaccaccaactgcaataaaataagtaccgtaaaaaaatattacatcaagtactgtggtacaaacccaaaacatacttttactgccattaaccgccttatctatatcctccagtctctttgtatcttcaaaagaagatacatcaagattatcaatctgtctgaaaatcagcttattcaattccttaccgacagccagattgcatatctgcccaaaacaattaaagacgccattcattatctgagaaaaaatataagttaaacccattgctaacaacgcaaaaataatctgcatcaatcccaacttcccctgggaataaacttctgcagaatcaaaaaatctctgcataaaaattatttgtaatgcccaggataaaccgtgaaggatggcaaaaatcacatagaacagcatcatgtttgttttcaaccggaataatactttcaggccccccagactgctagctaaaaaattatttttctgtttcatacttctcccataaacttttactgttccgcgttacgtgctccgacataccagcttctctgattcatatacatttttctgtaaacaccttcctcgttttccatcaatttcctatgacttccctgttctataatatgtccatcaccaataaccaatatctcatcggctattctggcagctcctaatctgtgagtaatatatatagtaaaacgttccttcttaacagaattaaataattcatacagctttgcttctgctataggatccaatgaagctgtaggttcatccaagatattaattgcagagtctgaatataacaatctggcaatcgcaagtttttgccattgccctccggaaaaatccacactattttcatatacctttccaagatatgtatggatatcgtcattcaaagattttactgtatcgaacaaaccgcattccttcaggacttcccatactctttcatcatttacagatgataaattcccaaatactatattttctttaacagtgaggaaatacctcgcataatcttgaaaaacaacagatatcatacctttcagccgagcgtattccatatctcttatactttttccattaataagtatttctccctcataattatcatagagacctactattaattttgtgattgtcgttttccctgccccattttccccaacaaacgcataatttttaaagttatccagtttgaaggaacagttcttcagaacatagttctctgttcccgggtatttaaacgtaacatttttaaactcaagagactcaaatgaaaatttctcatcaaccgaaggaatgtcagaagccccctctttttcacttaatgtcataaatactgaaaattccttcaagtattctttcagtctcgcaaattcatgcatagcccctgccagctgccacgacatgctttgcaccaaattaaaaacggcgcttacgagcgctatataaactccaatactcatcttccccgcagctatagcaggaagcagaattgtcattataactaaggaaatcaatattgttactaaagatccgcatttcatattgaaatacttttttatttctattcctgattccaatttataggatttatcaaataaaccctcatattgtctgctcaaattattactataagaaaacagctttcgttcttccgcatatttcttatcgataaggacatcagataagtaatcatattttcttttaatatttgaagctcttttctccatctcataatttttatgtccggtcttaaacgccaggccaaaaagcggaatactgatgcctaaaatggcgataccacctataaaagttgatgacataactataataaaaagagaaacggtatggataaacaatcctatccctttcaaaatattctgaaatccatcttcgaaattttttatcgggttcaggcatacacgattcacaagttcacaggtatctttgttttctatatgtttatattccaggcgggcacatttacgtgtgatgtccttttttattactatattcaatttatttctgcccgaagtattaactaattgtaataatgcaggcatcacattttcaattacaatgcatgcaaggatcagcagaatagggatataaattgaagagtactctttttccccttcaaaaatactccctgcattatcgataaaattcgctatggctaatgtcttcgcggccggcagcagcgaactgagaatcgtatggaggatgttgtacaaagactgcaaaggtattatcctcataatgagtaaaatgaaactcattacattatatttttttctttgaatcatcattgctccaatcaatacgcctgtaaaattattctaaactggtgtccttctcttccaacttctaagaccagcgcattgcaattccaccatttttctgtgggtggaaatacgctttccgctacttttgagaaatacgccatggtgccatcgggtctgtacagataatctgccgtgagcatcactaaatcatgctgctgcataggagataacgctgctgctccatcgcttttatcatcagaccttcgtattattttcatcccacaaatcatctataatgaggaatatagccatctttatatgtacaaaaacattctgaataatcattttcaaacacttgtaaatattcctccatgtgtggtgccaaggtatagttttttaacatgtctttttcaagccaaaaaacttttccttcattggtagctgttttcaaaatgccactatattcttttgccttgtataaatacacaaaatatttataatcatcttcaccttcccaataataaaatcctttgcattgcagattcgaaagtaaaagacctgtctcttctctaaattcacgaattgcagaatcatatatactttcaccagattccacctttcctcccgggaaagcaattcccttaaatcgttttattctgtctatcactaatagcttttctccaacttccaacattatcatattagttatcacaatctttgccattttctcctccacactctccgatttattgttcagcacacattcaaagtaaatagccgaatttcttattcaactcatattgcagaatatatctccaaccggcttcttccatacctgcgcccgccaacaatgatccaatcatccagatgaaaaacatatatttgggatttactttattcaggccggaagccaccaccattgaaactatataggcaataaataaagctacgacaaataagtaattgtatgcagaagtttcgacagcgaataccgccactcctcccccaaatatgagcctgataataaaagttaatataacaaattgaactactatttttttgttcatttattcatcctataaagtaaaattctttataattacaattggtttgcaaaataccgatttctcgacaagtccgacttcccaacaaactggaaactgcctaattctttttgtatgtgtatacatcaacagttacaatttcttgaccgccccaattcttttcttgcgaagtataatcctcttttacaaatttattgtttaataacacttttgatgaatataagttctctcgcataacaaaagctttaagtgtcgtaatattaacttcatttactaaatattcaaccattaactttaaaacgtttgttgcaattttcttattccaatattcttcatttagacgatagcccaccgttattttattttctctctttttgtagtcaaacatttctgctaatcctactagtctattaggattatcttttaaatagattcccgcaattatatactttttcttttcaaaatctcttccgccaaaatttttgattgcagtctctaatgctttaatacttttcttatatagaaacggtggtatatacttatatacattgtcattgttgcttatctctgacaacgctacaacgtcacttaattccatttttcttatcataactttatcgttttctaaacatggaaattcatcaaataattctgtcatcataacctccataaattataatttctcgttcagtccaacttttcactgaactgggaactatcatatgtcagtaatatcaccgggggcaatattattccaattaccatcgagcattttcgttagtgcttgataggtgatttttttaggaacaattttatttctaaaggcacttgtatctgatttagctgtaacgattacaacctgagatttcggcaaaaaggttaatctatgtatatccgtacaaatttcattattcaaatcactcaaaatagctttatcaagttgtaaacgaaaatctttattgtgcttggctgtccatataaaatcatacgtcataatcataaagtttccctcacaattccacttttccccttgccttattgatataccggtagttgttaatcccaaaccacaatgcagaacggatgcccagcgggatcgatcatagtaatccactcaccatctccatactgcatttccgcaagttttgcacctgatttgatagctctgtccatccattccgctaattcctttttatcctttactccaaaatctaaatgtaccatcatttgctgtttttctgattctgatggccaaacaggagcaacataatcttctgcatattgaactgcaattcccatatcgctttcaggagattgcagtcttatgaaattttcttctttaaatacaatgggccatcccaaaaaatccgaataaaaactactcagttggtgaatatggctacactctaaaattacagtttttaattttaatcccatttgctattcctcatacttccgtttttttgaaactttttattccctttttttaataaacaaactgccagcacacaaaaaatcagatatacaaaaatagaaataaccgacgcttcaataccaaaatctccgccggtaatcagaaacatcttattgtccaaaacaaagttaaatatagaaccgctgtctgcactgttcccaatatgcaaaattccgccaataatggccatattccaaattccatggacaatcgcattgttccagacagaatgactcacatacgcgatgagggaaaacaatattcccacaatactccccgctatcagtaattgaataatactgataaaatcaaggctgttcccaataatatgcagcgccccaaaaagaacagacggaataataacagctacttttatgttaaatcttttttccaaacaccccataatcacaccccggaaaaccacttcttcgactatcccggttgccaggccaaagaatactacagcacctgtaattattgccaaagtagtttccgtattaaaagtattcatctcccagtgtccgccggttaatatagaaatcagcaataccaatgcaggcataagaatagcggctatcagccagacgccctttattttaaatcgcggtattctcatttcagacatatccacttttaaaattttcttacaaagcagtattattcctgctaaagccagcaccacatataaaactcctgcaataacattacaaattgcaccgggcactcctaaattcagtagaaattcgctgataacaaaagctaaggtctgtgcaattgccagaattgcaacagaaagtataatacctaaaactgtttttgctgttgttaattcctcagccggtttctttatttctttcataattgtttcctttcagcctatcactctctttttgattttaataactaaccttaaacaatattgttacaaggtctctaaataagagtaaaattatgtattcctcaattactattttggctcctatattaaaatgagtatagcatataggaatcaacaaaactatcgttttatagataattgatgacagtattttattatatattgttttgcatcactccagagaatccagttatttgagggtattataaattgaactggaaacagttctttccccggcataacgaactacacatgctgctgtctgaagaactccaatctgtccgtaaaagaaatcaacgaaaaatacagctatgccaaccaatacttttttcaaccggcgttaaaaaagagaaaggtatcttcccctcctctttctggaaagggaaaatacctgccacttaactattcctgctattctcttttataccgatacccaatttatctgaacagctcactgcatccttatctgtccacataaactcttccctcactccgtgcagtaagctccgtcccgcagtacacctctgttctgccgtcctttactatcatgctgtaccgtttaccatctacaaggatattattaagatgtgtaccatccggcgccagcggattgccgaatatcacttggttttcttcatattccacaagctcctccaacatcagcatccccatcagcatgccccaattataatggggcgaaccggctccttctcctgtgattccgctgtaattttccgggcagaagccgttgcattcccactcttttgcaagcatagcagcggctctcgatgccagctcccaggccagcttattttccccggcccgtttaagggccagatatgtccagagtgtctggggcggccagatctgtcctctccagtagtgctgttggggaaaagcaggatcatcctttgcgatagaaggaatcatgtattccccccagaatttcttttcatccttcaggagctgaagcaacctgttttttctgtcttccggtacctgtcccgtcataagaggcatgaagcagtccggcgactgacgcctggaaaagcttccgtcaaatttcagattataatagcatccatcctcctcgcaccacatcattgtgttgattctatcggtcatttcccgcattttctgctcgtagcaggatgcctcctcttccttcccaagcgctctcgccatcttgctcagggattcacaatccaccgcatacaggcaacatctttccaacgtataaatatctgcggtatgacagctgactacataacgggattcatcctgcagatcttcttccttcagtccttccaatccttttatgcttacaaaatattcgccgctggtccattgggggctgtcgtcataggtttcaaagtatgcatactgtgcctttgccacataaggctgctgtgacgctccgagaattcccatttcctcctccggatcatatccaaagcccagaagcccttttcccccgccgtcccgtctccgctgcccgtccccacgatctgcaaaccaccaggcattcgctttcttcgcgccctcgtaacatcctgacgcccattccttatctcctgtatgcagataggttttccaaagagtcaatccctgtacgatatgctgggatcttcctgctgttatgggaggctccggcctgcctgaggcgccgggactgctgttcagggggattttcccatccggcagctgtacatcgtacccggagagcatattttccatggcaagttccggataggcccaggagcaggcccagctgctaagaaaggtatcccagttgaactggattccccagctgtcctcctttctgacccaggggcggtccacaataatataccttcttccggtattttccttataaatggcattataaaccggcatggaggagagtacccggccaacctgcttcagcatcccctctccggccagggccgtcatggaatgctcctgcagctttgtttccagaattttctttccattcttaagcaattctgcctgtttcgggctgtcaggcagatgcaggaaggcttccgcacgtccattttccagagtaaatgcaaaggagtctgcaaactgcagtcccatatacctgttcacccccatatcagcccagatatttcccggattcacattccgcagcacccagttttccctgaaatccttaagctgtttctccctgtcattgtagccgagcacgctgaccggggaatgatctgtcagcaacagcagggccgaattcccattttcgtggtaaggcgaaatgagttctcccgcgaaacagttttccgactgtcgggtaaaatttacccattctctttcaagtttccattctctgggaatatacagctcagctaaaattgttattccgtccggtacctctacctgtccgtacagacctttgctgtctgtgcggctccatgtaagttttattgttttgccgaatgcattccaggaaaattcataaagctcatccggttccattcttccgattctgacagaacggaagtcaaactctttctgatctataagctgcttttctttttttgctgcagcgaggaagcggattccaaacatttcattatccttacccactgttacgattccgttgggatagagtgcatcatatgcaccatatcccatccgttttgtctgattcatctccctgtctcctattaaatctgtgccgtaataagctccgttaacgctcccagcaaatccggctccagctccatgctctgaagctccgcaagcagcctgaacccgtcaggttccttacagatcgtttcatacaggccggctttccggttaaattccatttccgccctgttaaggaaccggaaggacagttcgctgacattgttcctgcggagtctgcaggaatccggatagctgacacagatttccgttcccacgctgatcggagggatctccactgttaatacaccgtttgttccatcataggccgtctgtacaggaacagcccggccgccggcggtcaccagggtttccctccaggcattctcctccgcctccacagcgttcaattctattttataagaacgttccgcgggaatgaatcctctgtttcccctggccgccccgattctgaaacacttccggttcttccccggagctttcttcccgctgtcatcctctgccacttcttcctgccatgacagactgtaatcggtcaatacacaatccccatccaggtaacccatgccgtcattgtcatcctcatacagcgtgaatacaccatccgctcccgcaaatacacgcagatacatctgttccgggctgcggtacacatctccggcgctgatctgctctgtcatgggaattatggttccggttcttacaaggacaggaatggaactgatatcccggtacatatccatctttcttcttcctgaataaaccactccggtaaagaaatccacaaaggttccctccggcagccaggttgtcgccttcccgacatgaagcatgggattctgtttccgcgtgatcgggctgacaagaaaatccattccgaaataatactcgttttttaccaggccgaatacctttctccactcatgtctgtaatacagcggctgtaccagaggttccccctctttataaaaacgataattcatcgtatatagataaggaatcagctgatggcgcagtctcaggaaatccttcatcatttccgcaatatcgctccggaaacgccatggttcctttccgttgaattcattcttggtggaatgcagtctcatgatcggagaaaatacaccatactgataccagcgtccttccagttcgtcatctttcacaccgcaggtatgtccgccgatatcatggctccaccagccatacccgatatttgacgccgcagcggtgaagtaaggctggaaatccagggaagcccatgtcacatgggtatcgccggagaagcctatcggatatctgtgagatcccggccccgcatacctggaaaaagtgattggccttttcccgtttttaccgctgtccagaaaatgaaaatgattcagcatccacagcggatccagctttgccagctttgtacgcgaaccctgctgccagtcaatccaccagaagtcaacgcccattttctcatgagggtagcagccatatttaaaataggcttttataaatgtgggatccgtaaaatcaaattttaccggttcttctgaatcagcatccacccccaatgcttccgccgcttccgggtaacatttttcatgagcctggattccctgggcggggtgcagattcagtgtggtatgcatacctttttcatggagccagcgcaggaatcgttccggatcggggaacagctcctggttccatgtaaagccggtccagccgtccccgtatttgggatcgatatgtactaaatgccaatccatgtcaataaccgccacgctgaagggtatgccttcccgttcaaaccgtcccatgagctccttatagctgtcttccgtatattcaaaatatctgctccaccagttgcccagtgcatatctgggaagcatgggaggctttccggtcagatggtaatagtccttcagacatcccagacagtcctgtccgtatccgaagaaatagagatctgtctcttccttgtccctgggaacgatccagccgttttcatccagcagcagggaaccggaatcatccagtaccgcccagccgtccatggacaataatcccggctcgatttcacagcttccgtccacctcatccaaagtccttgtggttccgccaaaattgcctccgctgtcgggcgggctgttataatgccattttcttaaggttccgattcctgtgatctcaatgctaaggccttcttcggagaattccttcctgtcataaaccaggcgcagatatcgggtcgtaatttccagcgaagtttccttctcgcagacctggaaatcacaaggggcaaactttcggtccagaacaatctgggtcgccctgtcttcaaagcatccctcattacagtattcaaggcgcagaagcctttccgtaaggactgtgattctataattcacacctgtcacaacagcagacggctctgctttggggcacgtattcagttttggtaatgtttccatctattctatcctttcccaatgcggaggcgtttcggtcccggtcatatccgggcgcgcttattcctttaccgatccgataacgataccggtaataaaatacttttgaagcagcggataaatcaaaagcaaaggaactaccgctaccacgatctttgcggcattcaggttttgctgggatacctgggatgcgcgcaggatttcctccatggttccgttccggatgatgtcttccatatttatcgtaatgctctggatatatgtcatcagcggatacttattgattctggttatgtacatcaggccgctgtagaagtcattccagctccccactatgctgaataatgcaaccgtggcaattacagggacagaacagggcaggtaaaccctggtcagcacctgcaccggattggctccgtccagaatggcggcttcctccagggatttgggaatccccatcatgaagttcatcagcagaatcacgttaaaaatgggtaccgctccgggaagtatcagcgcccagatcgtattcagaaggtgatattccttcagcgcaagaaaagtaggcaccagcccgccgttaaacagcatggcaaagaccagcagattcatatagacatcccggcctttgaactgtctcttatttttcgtcagaggataagccatgctgacggataaaaccgtattgataataacggccagtatcaccctcaccacagagatcccgaaagagcgccagtattgggcatctcccagaatttcttcatatgcaatggtattaaaaccaaccggcagcaatgtaaccatatttccttccacagcggaagcccttgaaaaagatacggcaacaatataccacaggggcagtaagcaaatgagtcccagtaaaataacaacagcataaatagatatataaccaatttttcctgccagactgctttttctcatatcccgttcctttctttagaatatcttgctgtccgtgaattttttagccagcgcgtttgcagacatcattaaaataaatgcaatgacggatttcatcaatccgattgccgtaccaaagctatactgcatactgtttaagccaacacggtaaacataggtatctataatatctcctgtctcataaaccgatgcactgtagaggttatatacctggtcaaagcctgcattcaggatatttcccatagccattgcggtcatcagaaaaatcactgactgcattcccggcagagtgacatggaacactctctgccaccagtttgccccgtcaatttccgccgcctcataaagccccggatcaattgatgtcagggccgcaaggaatacgaccgaattgtagccaaattccttccatacatcggtccctatcagaagaggctggaacagcgtattacttcccataaaatttaagtttgtaccaaaaattgcattcacaaagccatccagcccaaacagacttttaattgcagccgccagaacaacccatgacagaaaatgaggcagatatacaatcgtctgtattgatttcttcatccatttcacccgaatctcattgagcaggatagaaaaaataattgccataatggtacccagcacaatcttccccaatgcgataaccagagtgttccggaaaatctggaatccatccggaatctcaaacaaatatttaaaatgcttcattcccacaaacgcggatccgaaaaagcccttcgccggtttgtagtcctgaaatgccattactattccaaacataggaacgaaattaaacagcaatacaaaaatcatacccggcaggatcatgccgtggtagaacaattctgaagtgaaataccttttacccgcctgtcttttcttatcacccatctgactctctcccatgtgtttcagccttccggataccttcaccggcatcctgttttgactgctgcctttaggttaataccaaatacggagcattccgcggctatgaaccgcggaatcactgccgtacagcttaccgtttatttttgataatactcctccagctcagcgatgatatcgcttccgccgtttgcataccatttttccttcatttcatcaaaataagaaatgggttcctcacctgtaacaatcttgatatacgcctgcagctccagggtatcaatcgtcgtcttcttctgtgccattacgggcatcgtgggcggatacaggggagagatccagttggcattcccattttccttcagtttcccgatggaagcgccgcagccgatgattctggaattgtatgccttccagccggcgctggtttcactggttacattatccggatcctccagatacttcatcatggcctcggatgtatttctgttctcagcagtggtacattgttccggtgtcatctcaccgtttaaaacggcggtatgctccgtgaaatatttctccgtattttcataaggaattacctcaatctggtaaggcctgcagaaattgtccccgccgtcctttacaaactgtgctacctcaggagcggtttccgcggttgctgtcgccagatccccgaatactacattcagtatcttcacagccgcttccggatgttcataatccttacgcaccgccacaaagctgcccaccgcattttcatggtacgcattcacttttccgtccgcatctttcatggtatatgcaatatattgtgcttccggattggcgtcctttacatgggtaaaccgccaatcaggggtgtgccagggcccgaatgcaatgccgcactgattattaatcagcagggaattcacatcatcggcagttctggtaccgaactggggatcaagcaggccttccttaaaccacctgttcagcagctcccaggtattctttacagaatcatccgcgaaggttccccactcaatggaaccgtcctcattctgaagccagatatctgcgaatccgcccatggcaccatacagcccctgggcatcccccacattgtctgccagggcgattcctacggttcctttaccggaaatatccgcctccacaaaagcctttgctatgtcttcaatatcctcaattgtgatgcacaaatccccgtcctcatcgggattcagatttaactgatccagccagtccttccgcatccagcacaggatggggacaccattatccggattgctcccgggcagcgccatcagcctgccgtcgaatgtcaccatctccatgcagcgtccgtcaaaggaatcatatacgcctctcacatagtcgcatacatacttttcatacacatctgtcaagtcatatatcagatcattatccaccagttcaaccaatgtgttataatcggtaaccgtaaagatatccggaagatccccggatgctaccgccagagaaatctgttttttataatcctcgtcatttgcttcaataacatcttcaaaagatatgtttaacttttctttcacatatctcgtatatgggttgtcctcaagcgtatctccttcatacagagaagatatggtatgaggggatgcgagccttcccagctggactacaagctcatcttcatacggttcaaaagccagatcagccgctgctgcggttcccgtttcctctgtctgcgcagtactgggggcatctgtatttgttgtttcctggcttgccgaacctcctccgcaggcagcaagtgacagggtcataacccctgacagtaatgctgccaacagctttttactctttttcatactgaattgtcctccttattctgattttttgttatccatcaattgatgattcctacctttcatattttatcagaataatttttgacgtatatgataataattttgggttcatgttcatagttttggcaatttcatatgagagggttattttattgtaactttaaagtaaaatatgatactataatgaagttaatttgcataacatattttcgttatttatgtggaaatgcccgatatttcaaaaattatgcctgtcagaaaggagataaaggatatgccctataagatgctgattgcagaagatgagcaggaagaatatgaactggtgctgtacctgttaaataaactgaagctggactcttctctgcagatctaccatgcagaaaatggtaaacaggcgctgaaaattctggaagagacacctatcgaactccttcttaccgatattgaaatgccctttgcaaatggactggaaattgccgccaaagcacgcgcaagaaatccttatctcccaatcgttttcttcagctgctatgataacttttcttatataaagaccgccctgtcggtacaggccaacaattatctgctgaaaccgctgaaccctgaagaattcgaaaccaccatgctgcatacactcgatctgcttaagcaggctgaactccaaaagaaacatgcggacagccgtatccaggcattgaaaaaccattacctttacttaaagctaaaccgtatgccctgtgaaaatctgcctgaaatgggcggggctgactttgctgacgactataccctgcttcttctgctccactttgaagagtccttttttgactgcgagccgagtgtatccgaaggatttataaatttcctgcgtcaaattcttcccttctcctttgattttgtgaatcttaatccttcccaatcggttcttcttttcaaggatgagacgggatcacatatggagcaggagcagcttgccggtatatgccggcagattcatgaaaagattctggaaacctatcaaatccattgttattttgccatcagtacgccattatccgaatgtgatgatttgcccaatgcctatgaagacgcctgcgatctgctggaaacccgttttttctgtcaggatcgttatgtattccataagcagccccagaaagagcttttttccgaaaactatgatctttgttctgaaatactggtgtccgccagaactgatgtggagtcaggggatctggagcagctcacgaaggatatcctgagattaaatgaaatttttgagcaaagcagaaattattctcatatttatgcgcgttatacatactccagtctgatccagatcctttacaggaatctggatagtacggatatgccggacgatattgagcggatattctcctgttccttcatccatgaaatcgaggagattgtctttgcagtattagccaggcttcagacggaacagcatgccgcttcccccagccgaaagcatgtaatacagttagccaagcagtatatccacaaacattacagggaacagatctccctgaatgatttggctggcgccgtctacctgaaccccagctatctgagcaccgtatttaaaatggaaaccggcagcagcataaataaatatatcaaagcggtccggatggagaaagcaaagcagatcctgactcagacaaacatcagagtcagcgatgccggtgcggcagtcggttattcaaatacctcctactttatcaggagctttcatgagtattttggggaaaccccggataaaatgcggcagaaataaccagcagccgtttacggctgttctcaattacatgagaggaagaaatctatgcagagaatcaaacaatggtatcataatcttaaattatacaagaaaattttacttctaagctttaccgtcagcctgattcccattttgattctgggcttcttctctattcttcaaagccggaaactattgatttcccgcgaagagacttatcttcataacattctggagcaggccaactccactctggaccattttcttaccttacataatgatataataagcagcctcgcctgggatacttccatccggaattctgtagacaggatgtatgagaataactacgaaatgtttctgaccaaccgggaaatttttgattccaagctcccggtggtccaggccatgcataaagaaattgacggtatcaccctctataccggcacgaacctgtacccgcacaatggtacactggattctctcgacaaaatcacgtccgaaccatggtatcaggaggccctttcagcaacaaaaccattctatgcttataaggaacctaataaaatgcttctgatttctcctgtatcggatacctactatactaatatttttgtaatcaggctttcctatgagtctatgttccgggactacacctcactctttgaggatgactacgctgtgggaatctatgaccagaagggaaatcttcttttccagcacgcacagctggacgaagtatattccagctttctgctgtttcccgatactttgagtgaaatcccatttgaggagaacaggcatgcttttttctccgaaagcaccagcgataatgtatgcggctggactattctcatgtaccgcccccaaaaggaactcaccaactccgcggattcctttatctgggtcattcttgccatcatagccgtctgtatcgccgcaacaagctatataagcaccaggctgagccgccagattgtcaaccctctggagcatctggccagggatctgaaccagtttcaggcggataacctcaccgttaccatccaaagcgacaataatgatgaaatctcccacctgatccgtgcttttaacaggatggcccgccgtctggaagaaactataaatgagctgtatgtaaacaggctcgccaaacaggaataccgccttcaaatgctgcagtcccagatcaacccgcatttcctgtacaactgcctttctatgatcaatgccaaagccctgcgctgcgaacagccggaaatcagcaggattgccctcctgctctccacgttctaccgtaccacgctgaataaggggcatagcaataccactgtacaggaagagtggcagaatatcaccgcttatattgccctggaaaaaattcttcatccggcattccagatcgactgccatatcgatgaacgtctattcccataccgtattattaatcttatcatacagcccttggtagaaaatgctattctccatgggatcagcggaaaggaaaacatcgatacagaacctggaaaaatcaccatcgacggaacgatggggcctgactgcatgtattttacggtctcagacaatggctgcggtatggacgaaaaaacgctggccaccatcacatccgccgaaaccaaaggctacggtatccgcaatgtggaccagcgtattaaactgtattttggagatatctatggaatcacatatgaaagcactcctggcgaaggcaccacagctaccatcactttaccgttgatcgccgcaacctgaatggtacccgagctccaacaggcaaaacatgaggcaggcgtatatgtatttccaccaccctgcaataaatgttaatccagataaaactgcgcctgcatactataaagagaactataaaccttcttcaatttcattaattcctcatgcgttccttcttcgattatagcgccatccgaaaaaacaagcacataatcacaaaaccgtgaactcgacattctgtgcgatatataaagcgttaatttaccctcgactaaactattgaaattcttatacatcgtatattccgctttaggatccaacgcagctgtcggttcatctaaaattatgacaggcctgtcctgatacagcgccctcgccaaagcaatcttctgcccctcccctccggagggttcaaatccatcttcctcgaaatctttatgtatgtaggaattaatccccttttccagcgcattcagcttatcgccaaatccgcttttcttaagtacctcaatgaccctggcatcttcctccgtttctccgaaagcgatattatcctttatagaaaatgaaaacagtttataatcctggaatactgtactgattaaatgcatgtactgcgaataatcatattctcttatatctgttccattcagtaaaatctgcccttcggtcgggtcataaagcctgcataacagcttaatgaacgttgttttaccggcgccgttttcacctacaatagaatacttcttattatcagagatttttacattaatattcttaagagaccactccgtctgtcccggatacctgaaagaaacattcttaaattcgatctcatacggcgcttcagggacatcataactgcctgtattcatcgttatcggtacatccagatattccttcagtgctccatagtatccttcaaactgtttgatttcaacacagcttttcattaaatcattcattgaactgctgaagctgtttattgcagataagtacatcgtaaagtccccgatacttatcattttttgcagcacccggacgatcagaaaagaataggtaaatagttcctgcagcagattcgttatgcccgctatgtactgacttttatttattgaactcatctgctttttataaaagttctgggagatattcagatagtgtctgacgtttttggagaaccattccgacacatcaagcagccttatttcttttccatatgaaaaatcttcaatcacgcttattaaataattggtccttctttcaacaggcgccttttccatatccaggcttacatatctctcttttaatttcccttcaataacggcattaataagcaccaggataatcaggactactaccaccttgacgctcaaatttatgacaataaatataattccgacaaacctgactgcatttcccaaaatgttaaaagcctgatccattacttcaccaaagccctgtccattggcatataaaaactttttggctttttccttaacatccaggaaggacggatcctccagcttctcataatcacattttgacaatctgtttgatatcatttcctgaaaatctacaaacagctttccttttaaaacaaaacaatgctttctcagccaggaacagactacagccgttgcaaaattacatgctatcattgtaactgtatagattattatcaatttaatgttctggcttccgagtaattcatctattatatatttgggtaaaataatcaatgttaatggaatcacagaggataatatttcctgaatcaatgcataaaatatgtactttctctgaaacttccatgcgtatttgaataaatagagaacaccattcattttatcacccctcctgctgtctttaccccttccattacagtagataaaatagtactttttttcaacattaatctttgaataaaccgcttttataacagctatagtctgttttttatattttattgattattttttatgtaaaaatattactgtttataatactattatcctatgcaaaagtttagcctgtttgtgttttcgcggaatttaaaatcagatagttaaagggaaaaatagtcggcccatcacaaaagctctgcgcttgtaataacatcagcaaatttccggtttaaagaagccatgaacacatcttgaacagtatctgcagggattatgacgccattccattctaacgctttcgctgcacatccatctgatatcagcgtaaccttatagccatattctttagccgctcttacagttgtatcaatacacatatgtgtcatcataccgcagaccaccaattctatgacctcatttttcatcagttcattgtgcagatcggtttcataaaaactattgggataatgcttcactataactgtctctgtatccagcggttcaatatccttatggatttgtacgccctctgtatttgggataaaaaagtctgcctgcatagttgagacatgctgaacataaatagcaggcagattttgttctctaaaacttttcagcaaacctttaatcgtattcaatgcttcttccggcttatgtaaccggcactttccatcagggaaataatcattctgtacatcaacaataagtaatgcttttttcattttcttatatcctttcttaattttaagcaaagcatataagaaaatgattcgaaagtaaattacttactttttcgtacataggaaagagattaatagcaaatgcctttttcatcaaggatatctgtcatatcatgttcaatcatatattctatgccaatttcctgcattatcttgatcgccgacaacattttttctccccgttttgtcaagaaatattccactttaagagggtacccgtcatatgtttttttattaattaatccgaagcttttcagctcatgcaattgttccaacagcattttctgagtaattcctgctatgctgtgccggagttcggaaaaggagcattttccatttctgagttgaaaaataattatcgttttccatttaccttttataacgtcatggacaatttccaacggacatgtgtagctttccctgagtttcatattatcttctcctgcttttttcattcggctgcaaataagtaacggtgatctccggcagggcagacagcgtatctgccgttttactcacataccacattaaccttccctttgctgtgaagaaactgcctttccagctccccatgcagttcctgcagcttatccatacatggatcacagacatccactctcgtgcatttccattcaccatcctctttcccgcttatcatatcatatggcttaaccacacactttttcccgcagatatcacagtatgtctcagtcatagcttctcctttgctttttatacatataacctttgatctactttttcttttgttgctgcctgccctgtaatttatatagggtatttggtttctttctattatcatatcacaatcattctctcttttacaatggagatcatatcagggatacttcgctgccatacgcagtcaaatcctatataatgtatcgtgtgttctttataagcaaacgtgacaaatgtaatctgtggaaatgaagcaagcgatttttctgtaacccttgtttccggcgatttaactatcatgcaaaatgattaattacatctgccggacggcggtaaaaaacgtcgtccggcagatgtagttttatatatattcttacacaggtggggagattatgataagcttgcctggcagtgtcttataggatctcataatctctattaccaaatatttccccttctatatcatagatatcttcaaaaggtatactgatgtcatccatcattataataagccccttatacatatctattttctttacgctgccgctgaccgtaatatattttcctcccgcctttttttcatccggcttaaaataagtgacggtaacctccggccggtcagacagcgtttcctgcacgaatctgagtttttcgtctattatcattttcgcattttcatccaattccgccttttcctcagttagacgcgccgtttcccggatggccgcatcatggccggtcagcgcggcaaaaggggcaaattgtgccgctcggtcggaaacaggcatctgaggatgtgtttttgaaacgtggtggggaagctgaatgatatcatcatacctgtggatatctgaatttttattttccaaaccctgtccctcctttctatcgctccgcggctttcggcacaaacgaaaatgaaaatcgattgcaaacgccgtgcagagaaaccatatccctgaaaatgggactgatttagtttagaaatcatttcatctgctgctctgcatgtttgttccaaagttcataaaagttagattgatttttaatcagttgagcaaagcttccctcttctctgatttcaccattttcgagtaagaatattttgtcaacaaattctatcgcttttaaccgatgagttataagcagaatcaaactgtcttttttctctgaaaacaaattttgcagtactttttcctccgacaaataatccatggaagccgttgcctcatccaaaataatgaccgaagcatcctgcaataaaacacgtgcaattgccagtttttgtttctctcctccggataatttaatacccttttcgccgatattcgtatctaatcttttatccaatccttctatcttttcctttaataataccatatcgagcacacgccatatttcttcctgagcatattctttgttcatcgtaatattttccaatacagtaccgtcgaaaatgggggcatcctgagatacatatgatatatattgataatatttatctaaatttattgtgcttatatctgactcgttaatgaataaatttcctttcgttccctttataatacccagcagcgttttcacaaaagttgactttccggctccgctcttaccaacaattgcatactttttgccggcctccatttcatatgacagattatgtatagcatctcttctgccataaccggcagaaaaatttacagccttaattttgaaaggcttttccattaattctataccgttaaataaattagtatcatcccttaacgacaagaagtttacatatctgttataagcaactttatccaaattatattttacatacataatattaaattcagatatcggtgaatagatattatcaaccagcattactaaagcaacgatttttcccaaagaaatatttaatttccaaatacccattataatgataatgattttaacaaatattacgagtaagtaaaaaaaagcaaaaaagaattcgtgtatcatcactacttttgtctcagatttgataatttcatcgtatgctttaccgatatctgctttttcctgtttatattttcgatttacacgaaatatcattgtttccataagagcgcggacatatttattagatgtccattcagtctcaataaggactttttctttaatattgtaaagtttctttagcataagattagaaacaataaaaataactacatatccaatccctattacaaacattattcgtatactatacgtacctaaaacgataagactaaaaagtaatcccggcactaaactataaaaaatttcaataaaaaatccaaataaaatatttttacccgcctcagaaccgttttctacaatttgaataatctttcccgttccataattcgcatagtcaagaaaatttattttacttactttatcaatagccagtaatttaaaattatagtagattctgttttctatttttgtcgaaggatagttatctgcatagtttaaaatacagcatgcaattgttgtaatagcatataacagcaatggaatactgatgtagtcagtaatatcggccttattttttatctctgataagatatcgattattctttgaaagtaaactatactaagcacattcattaactgagacaccagtcccaaaataatataaacagctattaaacctttcagcttatatagaacattctttaccataataatccttcctgtccggttatgccttatgcccgccgatttgatcattgcgttccctggccatagccccctcttctaaattcatgccttttaaaatagcatttttcccgtattttttctggatggcaagcattgcctgctgcatctgtttttcccgtttgagctttgcctcttcttcctctttctttttttccagagcgctgtaatcggtaaaaagatcaagctgttcaaatgtctgcgtctcttctgccgcggtttcctcggcaacatggttcgcggtgacataaactcttctgaccagcaggtttttatctattattttatcatacaaatccaggacggcatccataatcagcatcgtggaagaagtccggcgtgaaatattggcagtgccatgggcatgcttggggatccggcgcccatagcgatccgtcacgacttcacccttgtaaagcctccttctgtccgggtctttcaggttttctatatcatatcctaccgtaaggactatctgatccgttacaaggcctttatccaccagatccagaaccagcctgtcggtcatttcctgtacgatgagccttgcctttttataatcatagggacactgcaggacctggccggagccggtactgtttgtggttggcttatatgccctgatgtcggccattgtacaaggttcccaaccccatgcatgatcaatcagcagttccgcatttactccgaacaggttatagagcaggtcttcattataataatcattaggcctgccgatggagcaccttgcgatatcccccatggtatacaggccgtttgcctccaatttcctggcatatcctcttcccaccctccaaaaatcgatgagcgggcgatggttccaaagaagctgccggtaggacatttcatccagctccgcaatccttgtgccgttttggtccggcggcatatgcttggcaacaatatccatggcaaccttacataaataaagattcgtcccgattccggccgtagatacaattccggtggactggtatacgtcctgaatcatttttaccgctaattcacgggcagaaagcctgtaggtattcagatactgtgttacatcaataaaaacttcatctatagaataaacatggatatcctccatcgctacatacttaaggtaaatgttataaattcttgtgctatagtccatatataacgccattcgaggcggggccgtaatatatgcaaccgccagctcgggagagctttttaactcctccgcattacaggaagagcctgtaaatttatggcctggtgccaaatgctgtctttggatgttagcctctttcactttttggactacttcaaacaatctgggccttcccggtatcccataggctttgagggccgacgatacggccaggcatatggttttctcggtgcggctcggatccgccaccaccaggttcgtggtaagaggatcgagctgcctttcccggcactcaacggatgcgtaaaatgactttgagtcaatcgctatatatacatgctctggctgtgacataggcaaatcctccatccaatgactataccaatatattataaccaaaaggaaaaggaaacaagcaatagaatgaaacagagtcccattatgtatcaaacgggcagcagatgtatattttcccagcagcggctgagactgaaaaccatagcccggtttattgatccaaacaataataaatccgaaccttttctgtctgaaaaagttcggattcctatcatttatcctataaggtataaggcaaatcacctattcgtgctgtctatttgaaccagttactctgtcgtgtcttcattggggatctgcctgacactgccgtcctcaccgtcaaccatcatgacaccgccagcagaagagccggaggcttccgtaacagagataataatattttcggcctcagccagttctgctttttcaggcgcagcttcaaaagatacccaggctgtgcttccgtcttcccagttcaccatcatggcactgtcatcaccggaatcggagatatccgacgcggaaaccactgcattcttgcaggccgccaaagcggaaccgctgtcatcagaaaaagtatctgccgcaagagcaggcattacggagagggatgaaactatcatagttgcgagtgcaattgttgttatttttttcattttatttgcttcctttctttcctttaatcagattgttagatatataatgttacggctatatttatattaaagatttttctaacctcctttccctgtttctattcgcaattatagcgtaccagagattaaggaacggttaagagccttacttttttatatcttatatcctgttagattatgggaagcatgacggtaaaaactgtttgtccgtcctggctccgggcggatatcgttccgccgtgtgttgtgatgatttcagaagctattgctaacccaaggcctgccccttccgtccccgaccgggattcatctgcgcggtagaaaggcttgaaaatgttctccagtttttcaggagggataccgataccattatctgcaatcgtgataacataccgcttgtcctcagactctgttgaaatatcaattctgccgtcctcaacattatatttcaccgcattttccacgagattagaaaaggcacgggtcagcataacactgttagcgatagtatgaaaaccactgcgatgaaggtttatttccaggttcttttcccgaattctcggtgtgagttccgcaataatatcacggaacatcctgtcaaactctaccgtatcattgaagtcatagctgtgctgtgccgtcatggcaaacaggttatccaccagtgtcatcatacgtttcagctgcctttcgatcacagtgagcgtcttttcatattcctccggttccggagtctcatcgagacgcaggacatcgatattcgttttgataaccgccagcggtgttttcagttcatgcgcagcgtctgaggaaaaacgcttttgctcggagaatgacttatcaagccgttcaagcatcctgttaaaggaatcagccaaactgccgatttcatcctgtgaggaaattccgtcaatgtgctgcgacaattcattttccgttatctgcccgatctcaccgctcaaccggcgcaggggttttaacgcacgcccaagcaggaaataggacataatacctcccccgataatgaccgccgccataatcccgatactataaatattgaaatcccttctggcctgggtgatcacaatggaaccttcttccgcctgtgaggaagtttcctccggcagcatatagacataggattcgctggtatcaacggatgcccgttcctcccgcgaatcagtctctgtctcctcaaaaaggaagggaactacaaatgactggtttgcattataaatagagagtgctgtgagtaatatacagacgcatgtgagcagcaaaacaatatagaacgtaaggcgaatgcggatggacttctttttcacttttcattcctcccggtttgacggcgctgtttctactttttaatagaatagccggctccccttatatttatgatgatttcctgcccgctgaattctcccagctttttccgcagcgtgctcatgtgtactttcacggcattggagaaaaaacagtcgtcactttcccatacatgctcaatcagttcctcagggctgactgcccttcccttgttcagaagcagatattcgaggatggaaaattccttcggtgtgaggcagacctcttcgtccttatcggtaaaaacaagacgcgcctgcgtatccatgcggaagcagccgaaagggatgaccgtattgtgctgtgtgaaatccctgcgcagaagagaacggacgcgggcttcaagctctccgaaatcaaacggtttaaccagatagtcatttgccccaagatcaagtccttcaatccgctgttcataggcgctgcgcgcggataagattagaaccttctgccggagatcgttttcccgtattttctgaagcagggtaaggccgtccatgccagggaggttcaaatccaataggataagatcgtatttattgacaaatgcgagttcatatccctcgtttccgtcggcagcggtatctgccagatatccttttttggtaaatcctttgcagagtgcattgcgcagatcagcttcatcttcaataatcagcagtttcataaatatttctctccgattcattatcgttctggctccgatatgtattatatcatttaataattaagaatcggttaagataaaaaacgatttaaaggaagcccccattacaggatcttccttttaaataaaatttatatattaaaatataaatcaagtcaaaaattttgaaaaatactctccagttccaccaaaagttccttcgttttttgtgcctcatccgattcacatttcatctgttccgacatttcccgcatcaattctacggctgcctctttgtacactgctgccggcgccctataatgaaagaaatgatcaaaattcttccgatacaagcactccagggtctcagaatccagtccgattcctctgactctaacaccatcaacctccatctcctcttctgtttcgaagaatcggcgcatccaggagattttctccatactctcctgaagatttgcttcgacaactgctggttctcctgcctgtgccgcgttatccgtgccgaacagaaaccgctcccgataacgccggaagaactccgccgtctcctccggcctggccgcaaaatccagatacatttcggtaccgggcgtaacgtcatagcagatgtttggataagtatcaaacagcctggcagcataatccagccgttccgaggtaaagaaaaagtgagcaaaagtaatcctcagtcccggatagcgcttcagcacagcttctacctcgcagtacagctctttataggaaggtatattacgatcctctccataataccagtcgttttcccgcgcccatcccggtactttttcacgatcccagaagctggcgggatctcccacatggaacaggataggccactgttctttttctgcttcctcataaaaaggatcaaatatctcatcatcgatggacagtttaaacttccttctggcattcggtttacagatcattttaaatccgtcaaagcctgcagccataagccttttagcctgttccagcatatccctgttatcttccctgttcagatatcgtctcaatccagccagcgcatagatgcgttccggtaaaagtaattttgcatacagactcagagcgttgcaggcaaaatccggttcttcatacaaggtaattgcgggaatgcacagcgcttccagcccacaggtttgaaggattcttgtgatctgatccgcattctgtgcacacggctgtcgaaaatccctgatcggacacaatgcatacggttccataatatggcaatgcagatccttgattccgcagccggctttactattccttctctccagaacagcctgttctttttgcattttctccctgtttttgctctcatcataccccatcagccatattcctcctagtataataatggtgtagtcaagaacgactactaagttaaaagttacaaagtccaatctaatcaatctatatagatataacggaaggaggagttctccctccatcagaagttataaggcaaccttatttaccttgcctgaggtttccttcatgcaccagacaaaagatagaggtataatcacggaaggcaggattatggacgtttcctccttgggaaccggccttttggctggtgaaacctctaaaaaagtctgtcagtccattcggtggtgatttatgttttggctggttgggatgccccaggctatacctgtataacccgctaggttgtgtatccaccttctggaattggatacctgccagaaaggatcaagttatgcactatcaaaaagttctcaagatgctggaaagcatcccctatctctctgtagggcttgatgtcggcgctgatttcacctggatgtccatcatgctcccaaatggcctcctcactggaaaaccctttaagatcatccactccgatccgcagtcccgtgagcttgctgtcacaaaaataaaggaagcacaagagacgtattctctcaaaagccgctgcttccttgagtccaccgggatctatcacatcccgctcctgtgcttccttcgtgataaggggtttgactgctccgtcattaatcctatcatcactaagaatagcacaaatatgaacgtaaggaaactgcataatgacaaatttgattcaaaaaaagcggctagagttggactggatgcttccctaaagacttccatcgttccggacgatgagatcatcgacctacggaacctggtccgtgattactattacttcaaagacctacagtcggcggtcgttctcaaactacatgcagaactgaaagtttccttccccgcttacctacaggtgttcagtaagatcaccacgcagacttccttaaaccttctatatgcataccctcttgccagggacatgcttgccgctccaaaggatgacatcatcaaaaccatccggagcacagcacgctttggggaaatgtatgcccttgccaggtatgacgccttatacactgccgcgaaagattccgaattgttcgggcgcgcccttcccagcaatgccctccggattaggctgtacatagattcttaccgggaataccaggggcatctggactccattctgcaagaactgcacaaggctgtagatagacttcaggggaatcctgcatataaccgcatccgtctcctacagtccctgcgcggcatcggctttttaagcgctgttgtcctaatcgcagaaatgggttcctttgacttatttccttcacccaagaagctctatgcttactttgggttggatcccggtgtaaatgattccggcaagctcaggggagacagggtccacatgtccaagcgggggtccggtcttgcgcgtcgtatcctgcatatgattgccataaacaacttaaaaatggagaaagggataaaaacacctgtaaacccggttatttatgactattacacccgcaaatgtgccagcaagaaaaagagggttgctgtcggagccgttatgcataaaatctgcaacatcattttcgctatgctgcgggataacaaaccttttgagatcattacacccgaagagcattgtaaacgctatgtgacagaacagtctgccaaaacagaaacagcagcttaaagatccaccactatgaaatttttaaattcccatatccgatgggtttattaaagtcgcctttttttacaccaactgctcaaaaaaactttttaaacatttttcactttatttcttgacatttcttagctggactatttcaatccgatatctcaataaacatctttttattccttaattcctgatgatgcaactccctgtatgaaccatttctgaaaaataatgtagattaccagtacaggcagtgtcagcaaaatcacgcctgccagagaaaggttaggtcgggcaaagtatttcgcctttaccgtattaagtcctaccacaatgggaaacagtttctcatcggtaagaaacgtagccggaacaaaataggaattccatgtccccgtaaaacacagaataataattgttgtcagacatggcttggaaatcggcagcacgatcctgaaaaatacaccagcccttcccaatccatcgattctggccgcttcctccatttccttcggaatactgtaaaaatactgttgtgcaaaaaacacataaatacattggcacacataaggcaccgtaatacttgccattgtattattccatccgatattaacaatcgtcagatacatcggtgtcacaaccagctgaaacggtaccatcatcgtcacaatcacaacaaaacggaggaaactcctgcccggaaaatcaaacttcgccagcgcatatcctgccattgttgtaaaccagacatttccaagcacaatgattagtgtcattaccaccgtattccagatccagcgtgccatattgtatttagtgaataaggtaacataattatccacagtaaaatggctgaacggtaccaacttatccacatcggctagcggcaggaaagaattatatagtgcatataaaaatggcacgataaacacaagcagaatgacgattaaaaacagatacagaaaaaatttcttaatgactttcatgacagtcccccttcttcctttcctcacaaccgatccggctccgaaacctttaaaactcggcgccggatcgttctgtcagggtatacttatgtattgtttatacgccttcgccatcattcatcagcttcttctgtgccacggacacaagcatgatcaggataaacagtacgattgccgccgcacagccatagcccatatcatagtattggaatgcatttgcataaaagtatgtcaccatggtgctggtagctcccgcaggagaacccagcttattctggctgacagccacaatctgatcgaaaacctgaaacgcactgataatactgtaagtcatgccgaaaaacaaagttggcttcaagagcggtatggtaattctgaaaaatatctgaatatgatccgctccatctatctttgccgcttctgtcagatccggagagatcgtctgcagtcccgatagatatatgactatataaaatccagaaacctgccagatataaatcatcattacaaaaggcagcgccaatttcacatcggtgaaccaagtgacatcaggaaaaccgaaaaaatgcagcacacgagtacagatccctccctgaacaaacagatacataaataccgtagccaccgcaattgaggaaataacatttggcatatagtaggctgttcgaaacaatgttctcgcgcgtatttttgagttcagcagccccgcgataggcagcgagaccgccagcgtcacagggaccgtgatgaccacaaactgtatcgtatgccttacggcaatccagaaatccccatttgcaaatagttttttataatttccaataccaataaactttgtctgttccggatggatgaagctgaaatcatacagactcatattcagagactgaatcagcggaagcacgctccataccacccacgtaatgataaacggcagcaaaaacagatacgcggtcgcaatctcttttctgcgcgataaagtccatctgcgttttttcatcctgcccttctcctttcccggagcaatgtgtaaaattaagtgctgattaccacagggtacttactttatttcatggcgttttccacattctgaagaatatcctctgcagtcatgccgcttccttccacatacagcgccttctccatttcatttctcagtgcatctgtgaatttgttcgtttccgccggataatcaaaactggttgcatattctgtcgccggaatcaatgctgctatccttgtattttcgttaaaataagcttcctgcagatcctggaaagcaggaggatttccatataactctgccactgcattctgtgcctcgtcacgtcccatatacgcgcatattttagccgcaatttccggatattccgtagagcttaaaacaacgtttgtatcactgtgggaagtacagccccaggtggttcctttgggaacccggatgatctcataattcatatcaggtgccagttcttccagtgttgcagtataccatacccctcctgtggacatggcgcacagcccttttgcaaaaacttcaccgtcccagccaagccccgcctccgacggagtgatcgcaacgccttcctgatacagatcaatcagatactgtaaaccctgggcattttcgggtgtattaatcgtctcacccattccccagcctcctccaaaggctttcacatactgtgtcagatgaaactcattgatattgatacacagccctttaacgctgtctgtcgtcagagcttccgccgctgtcctgacctcatccatagtctgcggcagttcaccaagacctgccgcattccacatatccatatttacaatgaatgcggctggtgcaccatccgtaggaatcccgtaaatcttatcatctatcagccaacatctatgaacttccgtaaccctgtcaaaatcataatcctctttggtgatataaggcgacagatccagaaacatattgttctcaatgaattccatataattttcattcgtcactgcaacaatatcaggtgcagttcctgctaccatctgcgcaggcagattctcccacattgttgtcgtgtcaggataccggatccattcgatggtgcaattgaacttttcctctgccccatccagtccggcccggaaagcctgctcctcgatctcacctccggtaaagccgaatttaatcacaggcttttcccctgtcacagcttctgcctgctctgtgaccgcctctgctgccttagtgccttcgtcacctccctgatttacagctggtgaacatcctataagacctgctgccatcacaaccgccataagaatcccaatcactttgttcttcatacataaccctccttctctttgtctgctttgtgataatcccatactaacaatctgacatctcaaaatatatacaaataattgatgaatcatttcatatattgacaaccatgttcccaatgcagacacacaatcaactattttgcactttcaataaaaatattgttctatcagcctgatttccccacaaattgacgattaatatttcgtattgttccttcccattcgctattttaacccttttcgatactctgagggtgtcactccgacaatacttttaaatacattatcaaaataaactctgttattgaatccaatcaattccgaaacctgataaggcttcagcgtatgatcctgcagcagtttcttcgccttgccgatccgtatctgattcaggtatttaaaaatattcgtctgtgtctccgccttgaaaagcctgctgatataaccttccgatacataaagatattctgccagggatttcagcgtaatctgttcctgataatggtccatcatataacctatggcctgtctgaccaaataattatcactctccgccggcacaaagaattgtcccagattctgttcgtagcctttgcggaagatttccatggcggcatgcacggatcctgcctgctgcacttctcccgctaaccactgaatttctgccagtgaaagggtaaatatatctcccagcataagctgaatcatccgtttgaaatattccgttcccacctcctggcaggcagacatttccttctcatagttttccagaagcccataaaaagtctgcgtttctccggctgtcaccgcctccttgcaggcagcacaaaatcgttctgcaagtgcaataaactgtcgctgcatggctgccgcatcataaggtttccacaaaaagagttctttcttctcctcaaagaaatgtctgctcagcgcctcctctgcctgtcgaagtccatcccggaaccggccttctcccttcagggtgccgctcatacccagaatcaccgaaacattgatgaactttttcagagataactgaagctttcttcctaactctaacaattcgaattccccatactctttctgacaggagagcataacataaaaatgattctcctggatacaggcgaaccggcgatttggaaaccgcatcaaaattcttcccgccacctcttccacgagatcctgaaaataattctctcttttattctcatatcgttcccggattctgtcataatccggaacggcaaaggccaggaacaaaactcgatcaaattttcgttcctcatcttcattcagcattttttcatcccgtgtcttaataaaacgctccaatcttctgcgatccttatgaaggacttccgccgtttgttctgtattctcctgttttggcctgttctcctcaatgatagaaagaagcgttccctcttccagggagtgcttgagcagataatcactggcaccggatttcagcgcctcccgaaccagagcgaattcctcatgacagctgatcactacgattgcggctctctctttctttccgcgaagcctttgtattacctctattccgccgattcccggcatagtgagatccaaaagcagcaaatccggacgttcggcttcgtatttctccagtgcctctgcaccgctgcctgcctcccagataatgcagcagtcatgcttttcccattcgataattgaacggatgccgacccggaccaagatttcgtcatcaacaattgcaattttcatggtgtcaccgccccttccattaccagttttgggattttcgctctggcgatagtataatgtcccggctcactctcaaaagaaagcccgtattcctctccaaaacacctgcgtatcctcatattgacgttgttcactccaattttattcagtccttttccatcctctttttttaatgtcagcacccgaagaattgtttcagcgtccatgccgcagccgttgtcaaagacctcaaataccacgtccccctcctcttccctgaccgagatgcggatcagcgcattctttttccagtcctgaaagccatggtaaatcgcattctccagcagcggctgcagcagaaatttaattgtcttacaggacagcaaagtctcgtccacttcgtattccaccgtaaagcagtccatataacgaatcatgagtatctcgcaatacagacggataatatgcagatcctcttcaatcgtaatatactctccctgaatctgtgttgtaagccggaagagctggatcaggtcatctatagcaccagtcacattatccgccccttgtacatcggccatccaacgaatggaacgcagcgtattatacagaaaatgaggattgatctgcgcctgcagtgccatcagctctgctctgcgtttttcttcctctgtccgatagattgcatccactgattcctgaatgcggccagccatctcattaaaagcctcggccaaaactccggtctcatcatttcctcctttagcccggatactccagttaccaatcttcatttctttcagacattcgctcaaacctagcagcggcctggtaatagaatctgcaagcagataagaaatcaccaccagcaaaagcagaatcgctgcaagtaccgtgaataacgcctgccgaaaacgaatcagttcctcatacatgacctgatacggtataattttgatcagtttccatccatatcgttccgatgtctgtaccacaccttcatatttttcgccctgaaaggaaaaaatcttacgttctccccgttccagtatacgaaccaactcaccagcttcttcctccgttacacctacaccatccgtatagcagatcatgacgccgttcctgtctgtcagcactgttactcctctgtccgccagactgctcagttccagtatatgccttatcgcactcaccttgatattcagcttgattacaccggcagagcgatcctctctggcatctgagaccatactccttcccacggagatatattgtcccttatccgacagaaattcgtcatgatgcaggtcaagaaccactgcaagcccttctgcctgttctatctgccgataccaatcctgaccgataaatgcctcataggtattaatacttcctacaggactcacacccaccgcatgaattgtccccgtattctccgcagaccactctacggaacgtatataagcattattataaaaaatacccgcgtaaatcgcgctgtatatctcctgcgtagcgcgtatctgttcatatttctgctgctccggttcgatcctgtcgtaatccttgaccaagagctccgaaaccgttttattaagcatcggatattctgtcagacgaacggcattgtccagaataatctcaacattttcgatcgcctgctcattattctgctccaacaggccatgtaccttatcatgaaccaattcagaataatacttcaatcccagtacccccattaccacaatcacaagcgccgccaccattatctgaagaccaaatatcttactccgtatactgataaatttcccctccacatccgttcccccttccccgttacctttcaaagcatctgatcagttaatgttacgcttccatccattctacgaattccgctttcccggcagatgtgcctgctggatccagattcccagcataataagaagcaaaccggcgaactgtcccgtcagtatccgttctcccagcagtaccgcgatcataacgaccgtgacaaagggtgtcagaaacgaaacagccgccgcagtctccagagagcaatgtcccaacataaacagccacagatagttgctcagcgcgaaagaaacacctcccagccagacagccaaggctacagcacatgccatggctccgtctgtcaggcaggctgtcacaaatccaaatgaggagaatcgcagaaccgccaaagccgacagcagcgttcctatcgccatataacacaaattagactctgcaatcggaagtctgatccgagctgaaaggacggaaaacagcgcccagcagcaggccgcagcgaatgccagtgcatctcccgtcatatcgctgagtctgacgctgcccggactgcctcccgtcagcaagacgatcacgccggccagcgcggtcagactgctcagaagaacccgcccgcgaagcccagtccgtttcagccaggcatcaaacacaagaatcaatacgggaaagcaataattaataatagaggcttccatagccggcagccggtacaatgcaagattataaaagaaaaaatacccccatgccagacaaccgcacagaagcagtttccctctctcccgtctccaaagcaccttatgggaaaattctgccttcatctgtccggccatctcaccgttatctgtcttgatccgcattttcttccgcgcctttaccttttttccaagacatataccgacatagaccagtaatgcagataaaaatacaaactgattcagctgaaacacatccagttcctgcagagctttcttactccccgcggaatagctcccccacgcaagcagcagtactgcggcgagaattccctgtcgatatttcttattcatagtattttatttccttccacataagtatagtaaaaattacgatttaatacaatttgttcattgtgattaccatttttttcaatacatattgctttctaagcttaccgcttttaatgaacagcagtaaataatgaaagcccggagggcattctccgcctccgggctttttggtttctgtttactggaattgcggcagataatcggcaaaggctgtcagactatcctccagcagatgcttcgccacctcaatatcatcaatcatcggatccagacaaagcgcttgaagggcaagctttctgtctccctctaccatggctttcaccgctacatctacaatctccttctgcctgttgcagaacacggccggtatcttcggcagttcccctaccgccacaccctgaatgccatgaattcccataacggccggcacttctacgacagcatctctgtccatgttagtgatcagcccttgcgtatttggcagattcacggcgtaatcataatgatgactgtcggtccagacagaagccatgataatctcggccctttcggtttttacatgctttaatccgtcaattccctttttgccgtcggccatatccgcaatatcctgccacatctgatcccgcatcaaatcctgacccttcagcggatacatctgaatatcatacctctcccatccgcctcttgcccggttagaggtaaacggcatatattccagaaaatgtgcgtcaccagaggtaggacactgatcaaatgtttctatgatgctgcgggtataaggctcaaattctttctgctccaggaacagcttcttaaacagcggtaacagttcttcgccagtctgtttgtccttgatcgaaagaaaccaagtgaaatgattcgtcccggccgccaaaatatctaacctctcgtgcgccgcatctgcaatcctgtgttcttccggatcatgattccaacggaaacaataatcgtgattgatagaaagtcccagtgttctgccaaggatccttcctgccatcatatagccaaaatcaatctgatgacagattccgaccatcttaagtttggtataccgtgccgccgcagtacagatccgcgtcatggggttagtaaaattcagcaccagtgcattcgggcacaattcttcaatagagcgaaataccggcatcaggagtgcaatgttccgtgctgcatggaagaaacctcccggcccgccgttctccgcatagtgaatgattccatatttcagggcaatctcgtgatctttttcccagcatgcttctctgtcaatcgccaccgaaatgattacaaaatcggctccgggcagcagtttccggcaatctgtatcctgacctatcttcatccccgcatcccattctctgttcagtcgttccgccagcctcgtaatctgcccgagtccttcctgattcaaatcacacagatacagctgcgcaccatgcagttcctccgtcctcataattgcacccaaatttgtcaaaccaaagctggcgcttcctgccccaattactacgatcttaggtccttttctcataagatttcctcctttgctaatagctctatggttacccaaagtttcactgatttccaaacaccaaaacggaagcccctatcaatgccgaactgccttcctgtccggcaggcaggatttcaaagtcctccagaaaatcctcccttcctaccgccagcctgcgcagcaaatcggcagccagaaaataatagttttccatcacgcctccccccaatatgactacatcgggcttaaaggcaagtaacagattccacataccccgctgaaaatatcggcaaagtacatccatcggctcctttgcttccgcctcccctgcaacccatgaccgatacaggccgccaaaatcttcatatcctgcccgaacggccctttcattcaatgccgtttgggaccagagactttcaaaacagcctctttgtccgcaataacatgatgtatccgctgcgcctaccatgctgtcaatcaccatatgcccaagttcaggatggtatttatgtcctgcacggtagagacggttatcataatcatatacggccactccgattccggtaccgaaacaagccatcagaaccctctgattctccagcccatgagtctctatttctcccagcagcgcgccgtttacatcatgttccagaaagacatccttgccagtctcctccttcagccgttcacagatcctcagtccctcccagccaggaagcgtataaggattctctatcacaccgtcaatacagttaaccggtcccgtacatacgattcctattccctccagttcctcatacctggtaccggctgtctgacataattccaggaaaccatccctcagttcccgcaaattgcacaaagcaccatctcttcccattctggtggatagtttcttctccgccagtatccttcctcctgtctctacgataccaagccgtatttttgtcccaccgatatctacagctccacacaccgccataaactgactcctatccttaactatccatattatcttgcctcttgttcttccatgcccagattctaacacccctcgattgcctccacaataatctaccgggagttggtatatattttattcacatgtgcaattttgtttgcatttggagaaatatgttttttggggatcctttgaaagtatgactttcctattaaaaaaaggctgcgcactttttgtgccacagccttttgggaaaaattattctccatcttcgtatatctctatccggagtacctgtgccgaaccatcctccagatttcctgtgtaatatacaaaaatcttatcattcagtttcagtcctgaatcttttacttcaaaagtataagtgttaccttccatatcggatacattcagggaatccgccgtcgcttcattaacaatacagtataattgttcttctcctgtcgcagcagcattatccgaagtttcctccgatgctgtccccgtctccccgacggttgtctgcacttcggatacggtctggctctccgagggcttttctttctgtgtatcctggctgcctccgcaggcggatatgcttatagcactgagaattccaattacaatcatccattttcttttcattttactgtctcctttatgtttttctgttatatagatgaaatctctgccgataaagtttgcttttattaaatttttttattttcaagacatcaatctataaaactaaaataaggcaggttttgattatgacgttcagcagtcttttcgttatctttctatttttaccttttttcttattttatattactgcagctctttattctgaaaaatgcggtttcgccggcaggcagtctgtgttcttatgcatgagggacttggggccttcggaatacgccggattgggtcgcgccgatgtattcgcctccttcggtatgagtgtatataagatttttgaatccagactttccactacaaaaaactttgtctgagcctgcaaaaaaaagatgcagctgccgaaatccccttcggcagccacatccttttttcctcttatttccaaccttctacaatatcagtccccggaaatatttaattgtaaagtcaacgcccttatctccaagctcacccttccaggtttccgaatgcggctctatgctcagcctgccattgtatcctttggcatacagggcggaaaggaaagccccccagttcgtctgatccatccccgcaggcggatcgtcaaaccgttttccgccaatcacaagggatcccttcagatgcacatgtataaaacgatctccccagtcctttgtctcctgaagatagtcccctccgtcatagatacaatgggaagtatcatacttgatatacagatccttcagatagccgtgaatcacggtatatgccatgggattatttacaaaattgttccaacggcagttataaaccgcgatttttactcccttttccttgccgcgggcgatcagcttttcaaaatatgcgatggcgaagctgcagttctcataataggaaagctcttccacataattacagcccgtaatatacacaccgcattccaggcgggatgccgcgtctatcaacctgtattccagctccagctcttcctgccggatgccgtccttgttgatccggtcgcttccccagcggcccatggctcccacaggcatttcatacgccttgctgaagctgatgacctgatccagatgcgataaaaactcctcagccctgtcgttcacatccagttccacaaaggaaaggccaagctccttcgctttccggaagttttcttcttctatccatgatataattcctaattccattattctgcctcccgtcagcagtccctttatcctgtttatttactcaaaatatactgttttcccgctcttagctgcttcatatatcgcttccagaatctgtgttacgacaagcgcctgctcgggcttgaccgtaaggggttccccgttcacaacagcgttataaaagatcctttgttccacatcatcagccttctccgccgccccgtcaaaaaaggctacgccgcctgcgctgaaatcaggagtttccacacactgcctgccatactccaccttgttgatacgcaggccgtccgccatatcggcaccggctttggtaccgcagaggctggtctgtgcctctccaacatccaggctgttgatggcccatgaggattccagcacgatagtggctccgtttttcattttgatgaaaccaaaagcggaatcttccaccgtaaacttctccggatcccagtctccccaggcatttcctgtctccgtctgatccgccagcttgcggaacacggatcctgacacggactcaggctcataattgtccatcatccacagtgtcagatccagcgcatgggttccgatatcgatcagcggcccgccgccctgtttttcctcgtcgataaaaacaccccaggtgggaacggcccttctgcggatagcatgggctttcgcataataaatatcacccagatcgccgtttgcgcaggcacgtttcaggtactgggaatccggcctgtaacggttctggtagccaatggtaaggatttttcctgtctctttggctgtttccaccatttctttggcttccgcataagtttttgccatgggcttttcacacattacatgcttgccggccttcagcgcggcaatcgtgacaggcgcatgggcattattgggagtgaggacataaaccgcatccagatcctcttttatcagctcctgataatccgtataaactctcgcatcaggcgtgccatactcttcctttgccttgaccgcacgttcctctatcagatcgcagaacgccacagcctcaaaatttccgtttctttttattgcaggaaggtgctttccgttcgcgattcccccacatcccacaattccgattttcattgttttcatgctctgtaaatcctttcttcctttttccggcctgctactttcttattccatcatacttctgagacagcagatactttttttcatgttttccatcggactgccgaaaatatggctgtcctgctccaccacaagccactgagcgccgcactcctgcgccttttccgcaatcgccttaatatcctgcacgccgtctcccacggcaaccagcttcacttctccatcctggatgaagtccttaatatgtacgagaggacaccgcatccggtatttctccagatatgccaaaggatctctccccgccacttttatccaacaggtatccagctcggtttccagatcctccgggctctgggatgcgtaaagctcatccaggggagttttcccgtctgccgttttctcaaattcgaacccatgattgtgatacagaagcttcattccgtattttctgcattccgccgcaatcaccggaatggctgccaggaattcctcatatctgctgccgccgtacctgcgatcctctgtaatgctgggaatggccacgtaactgcagccgatgctgtgatacgccctgactgtactctccagatccttatcaaattcatcaaaaggcacatgagccccgataggagtcagacccgcctcctcaagccatcctttgatctcatcaggcgttcttccgtagagtccggcaagctccaccccgtcataccccagcgatttcagctgctgcattgttccggcaaaatcagcgccggcttcttcccgcacggagtatacctgtgcggcaattggcattttttccataagatttccctcttcttctatagattattattcttcaaagcttattacctggttcttatctgccgactcgaaaatggcttccatgagacgcattacccgcatgacctcgtccagcttgatccggctttcctgtttcccctccagcacggccatcacgttctgatagaattcccggatatcgccggatactttgggtaattcttccgtgtagatgctgtcctctcttctgggcgccatggttttggtcaggcccgcagcggtaataacaggcaccacatccttctcatccgtaccgtttgcacggacaatacgcccgttcatgctccagtcctcgatcagcgcactgccgtccgcgccaagcacataccatctgggaagctggataaaattgctggttcccacttccacaaagatatgaacgccgttggcaaatcccagatccgcactaaacccgtcatccacaagctgattggtcacatgtgtgactgtggcatatacggtgttcagttttacgccgggatatataagcatcgcctgatccagcagatgaacaccccagtccagaaccattcctccgccatgctccttttcctgccgccagtccccgggaattcccctggaaccgtgtaccctggattcaatccgaaaaacctcccccagttttccttcctccagaattttctttacagtcaaaaagtcctcgtcccaccggcggttctgatgaacggtcaggaaatttcccgttctttccgctgcatccatcatttcctgcagatccttggagctgagtgtcaccggcttttccgaaaccacgttttttcctgcttccaaagctgctatggccacacttttatgtacgtcattaggcgcggcaatcagtaccagatccacctgcggatctgcgagcagctcctccagtcctgaataaactttaacggaaagggttccggcatactcacgcctttcctctttaatgtcccaaataccggccacttccagatcttccagatccttaatcagattgtaatgccagccggccataccgccgaatccgaccattgctattttatgcttcataatatttcccctccggcctgttctattatttaagcccagaacatatttcccttatcttcgtaaatcagcacattcttcaggaactgaatggccttcagcagcccttccctgccagacatcaggctgtcttcatgctcgatgctgatagcgtagtcgtatcctgccagacgcagctctgaaataattgctctccagtactcttccccatgtccgtatcccacagcgcggaagatccaggaacggttcagctcattcccataatgttccgtatccagtaccccgttcagcgcggtattgatggaatccaccttcgtatccttagcatggaaatggtacaaagccccggcctttccaagctcacggatacatgcacagggatccattccctgccaaatcagatggctgggatcaaaattggccccaatttccggtccgacagcttccctgagacgcagcaaagttttcgtgttataaacacagaagcccggatgcagctccaatgcgattctgtgaaccccatgctctctggcaaatgccgctttttccttccagtacgggatcagaacctcattccactgatattccagaatctgtgaaaagtcatccggccatgggcaggtcacccagttgggcactgcatcctgagggcttcctccgggacatcctgaaaaagtatttaccaccggtacccccagcttttcagccagcaggatagcgtttgtcagatcgtcgtcaaaagatttggcaatggccttgtcaggatgcaccatattgccgtggctgctgagtgcactgatttccaggccgtatttgttcagggtatccataaacgctttccgcttttcctcatctgccagcagctctgccgcatcacaatgagccttacccggaaagcccccgcatccgatttccaccatctgtaccccgttttcggaaagaaatttacatgcgtcatcaaatgacaggtctcccaatactactgttaaagtccccaatttcatttttttattctccttgtattccgcttttatttataggaaagactgtctttcctgtctgtcagtctcacaggaaccgcgatctgacaaagacattataaaaaaaacagcaggggaatgataggattcctctgctgaaagcacatatgattctgctgattttaatttttaattacttctaaaggcgtgcatccatagaacctccggaacatccttccgaagttgttataatctgaaaatcccaccgcgtcggccacctccgccgcggtataaaaatcccccttttttaacagatgcatagcctttttcaggcgtatttcattgatatactgaagcggaggcatccccatgctttccttaaataaatggttgaatctgtcttcactcagatggagcagatccgccagttccctgttgctgatggcttccgtataatgctgctcaatatactgatttaccgtattgagccgctccagcttctttctgcgctttaagctgtcgctgttcgaaagcatttcctgtacataattgcgcgacagataggtgattatctgcagcaggccacctttacaggccagcttatagccgatgtcctttttctcattttcttcatagatccggtgcatgatccgcccaatttccgtatctttcttgatccagggctgaaaaaggatattcttgtccgccagttcctccgacaacgcttccatttcaaagatcattacaagaacctccaccggacttccgtaacagtagccggcatggatcacattgctgttggctatgaccagatctcctttttctcccggaatttcctgctgatccaaaaggaattttgtcctgcctgaaaccacataatgcagctcgatgtgctcatgccagtgaggtgaaaaataccatctcttctcatgaacccggttgatatgcagctgaatgggaaactccttgtcattcaggatctttttctcataaaactttaattccttttccatctctgtgccccctggtaccatcctcccatagtataagaagctgtccccgataaaagtatgtttttgccattatagcatataattctgctgtttttaagagggatgttaatttccggatatactgatgttcagccgctgctgactgtaatgcagtccgtttaaagcggaaatatttattttatttccctatttttttcaagatcacaataccatatatccccagcataagatatacgataagactggcaataaatgcgagcggcggatattcgctttccaaggtaaagcaaaagggaatgccgcagaaatctataaaggtgtgaagaataattggtacccacaggtttctggttttacaatagaccgccccgaaataaacacctaatgccgccgcccacaatattttacacataattatgctgacaggcagattcattgcaccaaaaacatggcctgcgccaaataatacagatgtacacagaacagcatacagtgccgcatttctatttgattttaataacttttcaatgatattctgcaacagaccccttaaatagagctcttctattatgccaacccctatgtaataaacaatcccttctataattacacgcagagcagaaggagtattattcaacggccagagtcctgtcatgagcgttaccgttactgctgctgtggctgcggcagctggcagtccatacttctttaatccgccacaaatcccgttaagttcaagcccaaagtgccaggatgaattaacaaaatttctccaaagccagcagagaaaaaatgcaaacaggaaatttgtcattaatgtaaagtatatgggatttatatccgctatgtttatatcgggcaataatgctgccggtaaccctgtcagctccataaaagccattataactgtcaggacgagtgctgtagtcagggattttttcaaagtatcgtctcctttaaatgaatgcggtaaaatacaaagctgcctaactcctgatacccgaagtgccatccttctattataataaaatcagtccaacaaaaactcaaactcccgaaatatcaaattatccttaaaatcaaagatgtccagggaacgctctccttttcgcttttactgattggcagttggagagctattaattattgccttaagcgtatcatcagagcataaacatatttcctgcctaatctcgataggtttcttctgattgatttcatataattcctgaatcatatccggaattccatcacggaactgtatcagacagtctgcatgatatccatgccatgcataagcgattggctggggtctgaattctgagaagaaacataatactgctgccttacacctcattatagaatcttcttcgattttccctttgttgatacgcatcatcagatcgtattcctgtccggcaggaatatctgcataagcgtatccatggagaaaatacagacaattttcagcattccggcatttgcggaaattatccaccaattgaggagccacatgatattgcatactgttttcttctatttcaggaatcaatacgttacgagaaaattccgggtggaatcgtgcccaaagaatcagtttgcgatcctggattcttgaatcttcatgagctaacatttgttcacctcttacagtcaatgtgacttttcatcaaatgcacatccgttctggttttcacttcattccgtttcctgatagtcgagtagacaagcggctcacgccgcaagcccctcacagatccgtacgtgcgcctttcacgcatacggctcctcataataacatttgcttttagaatagactaacatatatctttggtttggcaagcggatacactttcagcatatctataaacccttcccatgtgtagcttttcatctgacttcgcctgtttagtgctttgcacaaatatctctgcgtatagtggagaaaagcagttatttttttgccattgaaggaaactccataatagcgatagtgtcctattaacttcctgttcagcttcccaatcagttcttttgctggcaggtcattgttgtcattcaaccattcttttatggctgtcagcttctgcatgtgcttcttcctgctggttttcagcttgacacagaagtttccactctttcttcctttaccgcaataaaaggtaaatcccagataatcaaatgtctctggctttccacctcctctgcgtttgcagttgctttccgcaaatctcccaaactcaatcagacggctcttgctttcttcaagttcaagattgaatttccccagtctttcttccagcattgcatagtatctttctgcgtctgccttgtattggaatcctgcaatgaagtcatcagcataaacagccagaaaacttttcccgctggtctcctttaacactacaaacttgtaccataaagtcagtacattgtgcatatagatatttgcaagcattggactgatgatatttccctgtgctgaaccttcttcactatcctcgtaaacaccctctgttattattccggcttttaaatatttatttatcagccataaaagatttgtgtccttgatatatagtttcagaaactccataagccaatgatggctcatatggtcaaagaatcccttgatgtctgcgtctaccacatagttaatccagtcattctgtattctgtggtgtacttcctttatcgcatcatggcaccctctgtttggtctgaacccatacatacagttcagaaatctcggttcgtaaatggcttccagtatcttcttcactgcaagctgcacaatcttgtcctcataagaagcaataccgagcggtctcattttcccattgctcttaggtatatataccctcaaagatggcaatggcttatatgccttattcttcagccgccctacaagatttgttatgttttcttccagatgttcctcatactctgcttttgtcactttatctattccgacagcctttctgccatctgattctctgtggcactgtctgagcatttcagcatttatcaaatgatacagagatgtgaactctggcttcggcgttgtcgccgatatttctgctattctctctaatttcgttcccatcaatacctccgttcctgagcacggttgatgtgtcctcagaaagaccgttactatgtagcccccttccctccgctggcattacccagtttcatcagtactatgaagctatccgactgcctatcactcattcgcccatctccatcttctagttgatgaagcgtacttgtttccaagaagcaataggctctccccagttgacaattaaccactatgtcaagcatgattggccctttgaccccgcagtgccgacgaactctcaccatagcgagttagccgatgttgctttccgaaccagttaagacgtcagccctctgaaattcaacttttcgaggctcaatcgcattgcaaccctacttgcttgctgtctacgcttcgcaacaatcattactgattaccacgcaagactcgctactgctggttggttagaccttaaacagacaggatttgcacctgttaggttaattgccctttgctgggcgcacagctggaattaattacttttatcttctccccgaattttcatgtttttccgttcttccagttcttcaatctgcttcattaaacaatctgaaaatgttccctcaacaggtactgcttcacctgttgtataataatcaagaaggacaatgttattatctttgtcaaaacaaaatatctcatcgccatttccgactatggataaaaatggtatatagtctgtaaagccgtcatcatgcaactctttcgtttttttacgtatgtccagaaaatccggtatttcatcagcgattccataaacaatgattccacggcagaaggaccagaagggtcctatgtcatactgttttgcccgtggccatatttcttcccgaacctccatgtaaagaccgcctaacggagacatggtaaatttcctgaattctacgggaagctttattttatattggctttcaaaatctttcacatcttcttcagacggctcatttcccatacaggctacgacttgataggtctgtttgtcgtagctgtgaaaataatcataaacttcttttaatgccatggctgtacctcccttgataaattgcaattttaattagactatatattggggataggatgtcttcttatttgtttgttttgatattctattttaagaaaatatatacttaaatttattcatttaatttatttgtattatattccacttttaattcctccgccaaatattcatcactcatacaatgcatatcggaaacaccctcactgataagccgatagacctctgagtgataaaagaaagctaaagcatcatctaaggaaatactcatattcgaggcaaaacattctatcacacgggcatattttttctgaagcaaaataggattcgcagtcatatctgttcactcccttcaaaatgcaggtaattctctatggcattttctgtacgaaggcaaatctgcatattaggtttttcataacggaggcggttaatagcttccgatttatcaatcagtccatcaaaatatagttcaaccgtattaaacaccttatcattcgccacgccgcccatcacaatatcataatcagatgtatctttcccgctgcggcaggtcaggataaaatccaaccattcttcggaataagaattaaattttaatacttttagatcatcatatgctgtctcattaaattcataacgtgacacaatgccatttttaccgcggcgcatgaactttccacaccattttacagcctgatcataaatcggagttgtataaaaaccaagtccaaagtccacattaggcctggagtgttttaaatccgggcgaacaatctccatcacttagtcccttgtaagcagcctgattactaattctgtccttttgatattacgaattagcatatgtttcaaccactacaaaaaagggcaaaacacagacaatctcccatttcataatatttaacctgtgtttcaaatcctttctatcattcagttggcttacttttatgatattttattgtttcatctgcattaaacaaatataaatacattcatttgtttcaatatatcagaaaatcaataattcttctattattgattttctgatagttttgttaattttgaactttcactcttttacattcttaaaatattcttttaaattatagctcattatcctttgataagcattctttcacaaaacaatgacttttttacaatattttgaattttgtttttctcctcacaataccgcagggcttatacaaaaaaatccctggatttctccaggggcgaacttatttcaatccacaaagccgctaaagcttcgacctagaaaatctacattgccgcccaagtccatgttaaattcaatccacgaggctacgtaagcctcgaccggacgaatacagaggtcattacccgcggtgacagtatttcaatccacaaagccacaagggcttcgacaattaactgccttttccgtagtttttaacatgccaatttcaatccacgaagccgcaagggcttcgactgcagctttagattatgcacaacaggtaaagcacatttcaatccacgaagccgcaagggcttcgaccttaaggtggccagggatacagacatcctgaaaatttcaatccaagaagccgcaagggcttcgacagttatgcaatgactgaagaagatatcattaaaatttcaatccacgaagccgcaagggcttcgacgttgtagaccggtccagggcggcacctgcaggtgatttcaatccacgaagccgcaagggcttcgacaccaaatatacctaaaaataatctcattacacaaacttaatttatataattattttattttctatctcatataatctttatttaaatcattttcaatctcttcatcaatataacaactctttttctggtgcgaatctcccggtactttcatgtacgcttcctattcgcaccaacataaatcgctccctttttcccaattgaatcagtatccttaacccttaaaaactctatttataccaacatcaaattaacatattactttgaattttgttatacttatacaataacaatcttttctataaattaaagtatagcataaaaaattcaaattgataagcaactttcttcattaattcgtaaattgtacatagtttcttatacttcaactaagacttttataatatcccctgcagtatctatatctaagaaaaatttcatattgattcaaatctttcgcaatattcttttttcaaatcattgtcttacttataaatgaaattcgcccacatcccgcataagatggtgtaattggaatgaatttcatgcccccgcctatctccgtcacattcactttttcaaaccagtccaggcaatttacgcatttcccacagcatttggagccatattaccccgaaaacagtaacggctcaacaaattgaaattattttttacagcaaactaaagattcatactataatacaaataagctcctgtatatgcactttctgtattattctcttttctgttatataatttaaatccaacgctttcatagttcttaggagcaactaaattgctattcgtacacactattattctttgaagaccatcatattctttaattctccgaacagcctctgctaactgcatgtggccatagccttttcctttaaacttttctctaatcccattatgacctatctcaacatattctggcctgtgtcgaggatcccatgtaacaaaaccaatgggaaaatcttctatacaagttactaatccgtatttatctgctatatctggattgtcatagaaaaaattatctgactcctgccagttctcatcccatattatcttatttctcgaatcataagaatacgcatcgcgtaaaatatcatacatagttcctcttggaaattcggtgaatttcctaaaacaaatcatattactcactttatttacctcttgaaattcctatttcagtccgacagtctgtgctttgaaaccgtaatttcttggttttcagagaaccagttatatgcggcttcgcaaaattcatcacagcgtaaataatagctattatgtacatcgtttatttctatcaacttttttttacagtttaaagatgaaaagtaactgtcaaaatactctttggaaaaataccgatcatgcagcgtcttaaataccagtgttggaatagtgatgctattttgaatagggctgtcaggagaaataagacattcaaatacagcattcattactttcgtactgctcttaaatatgtacggatttcgttttatcagcatctcataaaatccattatcctgctcacagttatatccattatatttgggcggctttatggttagatggaaattaggcagtcggctaaagagccaactcatcattttcacagcaaaatatggatatcccataccagcagtatttttataatcaacgcaggcaaattgggcgaaactttttattctgtcagtggaacagatgtaacattgtgcgaacataccgccgatacccgtatccccaaataaatggatgttcgaagaataatgttcttctatataatcaacgagtttatctaaatcactcacaattgaatgaacggaaaacttcttttcgtctccgccgctttttcccgttcctgaaaagtcaaacgcgaatatattgaccccatacttcgtcaacggagcatatgcggactgtacatccaatgtcgtacagataggagtatgtgttacaataatattcatcgccgattttccggtaacatagcaattacaaaacaggttggtatcaccgttaggaatttgaatatgattccactccatgtatttcctccatttccataattcttaagcaccagcagtcaccagtatgtcgttcattctcattcttagcaaagtttaaattaccgtttcctaataacccaatcatcattttgagtttttctttctgcgtaacagccacaaggcatatcttttaaagtactgacagattgatccaagtcaaaaacccattttaaagatactaaccttgcttcatctatttcatgctcttttccgcataggaattgccacattccatcatcttcatcatgtgatacatacagaatgggggctttattttccgttatgtgacaacagataatcgctgctgtatcaggatcatcataaaaagtatattccatgcctgaagctccttccaaattctattttttgtaacaaagcagatggcagttttcatccccaaagacaactcaatctgtcttataaaccttaattttgtattctccgataaaatccttacactctgctgctaaagtatatgtccctgaactatccagggtataaaaagtttccagtgcctttgcctcatccagcgtatatactgcattaccagccgaatcatacaagaccatatttaattctccatttacaatattggatctaaatgaaaactttattctttcgcctgcttctcctgaaaatgaaatatcagaagctgtagtaatttgttctgtatagctgttcttcatattacctaaaacagttggacgggttagcaggaaaatacctattactgcagctgctataatgataatccatattattatagttttctttttcatctcaataccctttcagcttctaatttttctttccgataaactgtaagctagttatctgccttttctgtaacttccgtcacggttaactgcagctgatactcattttcttcgccattcaaatcagtagtttttaactcaaagaaaagattattctgcaattcatcggttcctatttttgtcataatatccccggatatctttcctgtatcaccggaaatatttacagttccacctgtcatatcctctacaacaaaagacatcaaaatctttttttcattgccggacatgacataaaaggttttggtatacgcagcaatatctgataatttatcctgcttttctttcaaatcgccgccataaaatgtttcctccgtggagttcaaaacaatgactccattcgagattgcgaactgttcattttctccgctgaaagaatagacagataagcgctgctcctgattagctgatgagttactgcagcctataaacatagtgcagcaggccagagctgacaaaaggataactactatttttttcaaattatcacctttccatatgactgcttttcaattcttaataccattgaaatcttgtacaaattccattattactatctcgtttccatccaaatcgtttaatcgaacttcataagttccccaatcatatctaacggcttcagacagagccaccccttttttcttcagagattccatcgttaattcgagattatctgtttgaaaaacaaaggattgatatcccgtcggctgcgcatcaaatactttacaatcccatatacaaagagtgggggcattttctataaagccaaaataaaccccgtttgaatcgtctgcatctatcttaataacgggtatttctaatacctctctataaaaatctataagctctttcgcgtgttccgaaaaaacatttgtacaataaaatcctgttatcatcttctcccctatccaattaaatgctgtcattgtctttcattatatctgagcctcatttgtccgctctgcagaatacaggaaaaaatccatatctatatacctgaaattcttagtatccttatcaataatcttcataccgtttcgtacagcaaccttttgagacgctgtatttgtatccctgacaatagaataaacggtacttgcactaagaacattgaaagcgtattctttacaggcaattgccgcttctgctgcatagcctttgtgccaatacgctttttgaaacaaatatcctatttccaatatttctttatctctccagccttgtaatgtcagcccacattgaccaatcatttcatttgtttcttttaagacaacagcccaaagtccaaaaccgtactctgcatatcttttaagttgtctgttaagccaattctgtgcttcttccgggctgaatgcacttccataagcggtatgcatgacttcctcatcacataatattttgcacaaagcatcaaaatcggactgcaccatttctctgatgataaggcgttcagtttctatcaactcttttctgttttctgaaaattttactgccattggtaattcctccacaattcatattcctgccaaattataatcccggcaaaaaaactccaccgctccctgacagaccgatacattcgcctttcatgcataaacatcaccaggtatcgtagttatcaaacaccaactgctatcatatatgtactttttattcatctttaaaagcagaacagaaaacagcatcattataatatatgctgcaatctctataagaactgcataaaggaatgtcaatacatcaggctctgcaaatccatttacaaagttacctgtaaactgacaacgaatataatcaaacagcagataaaccaccataagtaccagtgttattaaattaaccactgatacgatgcgcctttcagcatcattgcaaaacaacagatagcatccaacaaatgcaataggattaatgacatgcagaaagaaaaacgctcccttaaaagctctgctcgctccaatccaatttggacttcattattgcagttttctatatagctctaataaatccaatagtttaactgtgagtggatttgaatagtcccaaccgtccgatattccctttgggtaatatggatagaacaaatgaatgtttcttatccgctccattttatccaactcatctaagataaaacagagctgtttctctgacatataaccgggacgggtgtctttattattgatttcttcttgtacatgaatcctgacttcttcaatcattgactgaaaatccataactccatccttataaatttttaaaatatatcatcgccgtcaaaatgcaggaaaaccacctcttatttacattattctctataaatatttttcccgaaatcataggcttctctaaggtggttcgttttggcaatctgcggttttccattcgtatctccgcatcctccggcaagcagcatacctttatcccggaaaccaatataattgattattgtaaatttgtaatatgatactgcctgttcatatgtccagaaaaaatcatctgctgatgtcataagcaaagcggcatcttttaccggatacctttcatatcgcccaaacggcggattcggatcttcctcagcaatacaataaaatctctcgatgaatgccttgattttggaggataacgtccaaaataataacggcgatgcaaaaacaatcagatctgctgccttaatcttaggaaccatctcattaaaatcatccctttgcacacatggtttcccataacggcaagcgttgcacccaatgcagcctttcacctcatttttatttaaagatatcttttcaactgtatggccggcctccttagcgccctgaataaacgaatccgctaactggctggtattgccgttaatgcggccgccgccttgtaccaccaatatgtttttcattacagcctcctagtgttcctttttatctgccgtcaaacagggattcattcatttttcaaaatcatccctttttatttattcaggaatcggctcaaattctttcaaatcatcatcggtaatttcccgaattactttgcaggggctgcctgcggcaaagcacattgagggaatgtctcttgttacaacacttccggcaccaattactgaacctttaccgacagtcacaccggcacagataacaacattgcttccaatccatacattatcctcaattaccacctttttgcagtacatttccccgcggctgcgtgccttatagtgcattggatgatttgtggtgctcattgtaacattaggcgcaataaggaccctttcccctatgacgatttcgtaatcatcaactaatgtaagattggagttaatataagtcccgttcccaatcgaaaccgttttacccatcgcaagtgtaagcggaggttcaatccacacattttccccacaaaaagcaaacaaatcttttaaaattctttctcttttttctgtttcgtccgctctcgtccggttaaaatcctgacaaagcccccgggcatatatctgttgattcatgttttctccagtatcaacccataataaaccttctgcccttcgctcggccattgacagtgtaacagcatctttcttcatctttacttcctccattttaatttatccgggcttaagaaccggaatttatttttcatcttttcgtcttacaaactcaacaaaggcgaatataatagatattacggttaaaacggaaactattagttctgacatatttgctgcatattctgtttgcgcaggaactattattcctaaaagaagaaagtaaatacaccaaaataatcctatcacaagcaggctgatagtactgtattttaatatagctgcaaatttatttactaatttccgtacaaactctatctgcttttgagatggcgctttcctgcgaaatatagatttcagaccaccgaatatgacaccaattattatccctattgatatggcaataaaaatagaacgtaagccatacatacctattctccttttcaaattatattttttcgctctgtttttttaatagtatagcatatagaaatgaacaaaaccattattttaaagctgctgatacccaaccaaatacagaaagagccctttccactgtcaccaaaacagtcgaaagggcccacccgtttcttccaaatcttattatgaacacactgtcaggcaagcatgcagaaagcgcttcgctctgtcagtgaaatcagtatttatttatgcttgtccagtcaaagccactttcagaacacatttaagaattatttcagaatgacacctgaatgattcagggaaggaaagttaaataaaataattaatatctgatcctaaattgtcttaataaacaatttgggtaaaaactctctggcacaatgccgccagaatgtccagtcatgccctccctcttcctcaaacacctccactggtatgccatgtgcctttactttcattaccgcttctttcgttttactatagaaaccgtcccgtgtaccgcaagctacaaacagcatttggaatatcttttcaaagctgcttctgtcatataaaatttgtctgtaatcagaatccttatcttctataatcagtcccccgctgaatatccctgcccaggcaaaaaattcaggatttcgaaataccgttctctgtgtctgcattcctcccatggataagcccgccatagccctgctctctctattgggaacagtacggtacatatgatcaataaaggggatacaatcctttaccagttcttcatcaaaagaacctaatgagtgatgactgcttccatccctgcgaaaagcatatccggaattcatgacaataatcatttcctgcatcctgccctctgcaatcaggcaatccgcaatattatcaatttttccttgccaaatccagcctgtttcattttctcctccgccatgctgaagatatagtaccggatatcttttttctatatttcgtgcatatcccggcggcgtatatacataacacatcttagttcttcctgtttgtgaagactggtaataattcagatgtatttggccatgcgggatatcagacagtaaatattcgtggaaatctgtttccggcatttcaaaaaaattaagagccttaaacgcgccatatcctacaggagccatagggttcagtaccggattcccatttacataatactcatgatagtgaaatcccggatcaataccttccagccggacggtccaatacccctgacttccctcttccccatctgctctatttagtttcagtcgtttcatcccataaacttcaacttccactttttcagcatcaggcgccagaaaccaaaaacttacttctgcctttccctctatttctactccatgatgaatatcacggtaacggccagccggatttcccttatcatctactgcaaacaaaatttttttgtaggcaggatcaaaaaataaaacctgctcttcccatgtctgtttccgcagcatttcccctgaaatctgtgtctgcggttcactcccctgcttatccatgatatctgtcgttattccctcaataccgtccttcttaaacagcagtgcagcaaattcccttaagctttcacgccagacatgccattcatggaacccattatagctggcccggctgcaggaaattccctgttccagaagctgcatgcatgcggtctgctgtttttccaatagtttttcttccccctttccgcaggaaagaaaaatatgataggccgcatatgttttttcagtcagaattttatccaactctgtatctgccatccctgaaaacacacctaaatatccaaataaattctggtgtttagcaaacgtaagcattgcctgtgcggatcccatggacaatcccgctattgccctgtatgcccttcccttttttacccggaattctttttcgatacaggggatacagtcttctgttaattctttgtcaaaatctccgggataaaaaacaggatctgtctctggaataaaggaatacccacaacacattaccacaatcatttccgtacattttttttcttcaataaggttatccaagataaggtttaatttaccgctccatatccatcccgtttcattttccccggccccatgctgaagatacaaaaccggatattccctgtctcttttctcttcatatccgggaggcgtatacacaaaacaggctttgatatgggaattaacttgtgatttatacttcaatatctgcacgtccccatgaggtacttccttcaaataataaaaatccgttccttcttcaggcatttcaaagaaattaatagctttaaagcagccatatccaaacgcaccatggggattctgtacttctaccccatccacataccaattgtgataatgaaaaccgggtcttattccatctactgttgctgaaaaatatccatttccttccggtttgagcgagaaatgttcatttcccattgtccctcccaatccggcaacctctactttttttgcttccggagcaaaaaaacggaaacggacatgtctgtcctcctgcacctcaatggccccgggatcttcaatatactgaatggaatcgatattaccgctttccttcatatatacttttttatttaacggatcaaaaaaaacaggatgcatcgttaatgcctgattcttccatttccccataaactgcctccctttttatttcagcgcaccaaacgccatattacgtactctgtgatgcgtgtattcttccatattcggttcgagattgtgcatataaacaacagctgccttctcactgggatctatggcaatataggttcccatatatccggtccagccaaattcccccactgatgtgttgcttccggatcctggggataacatggtacgtactccataaccatatccgtatccggccagataggagccgctgaaatccttaagctgctgttcattcagctggtttgtacgcataagatcaattgtttttcggccgataatattccttcccttatatacacctccgcaagccatcatctgcgaaaaattcaagtaatcccggactgtggaaaataagccggccccgcctgcttcgtactttgcatccggctcatgtctgtggtcaaacattcctttgaccggtaccatacttccatcttctctcctggaatatggcgtcaccatacgttccctgatatcaccaaaataacgataacccgtgctattcatttccagcggttcaaaaagttcactttgaaggaaatcgcttacttttttccctgaaacgacttctataaggccggcaaccagttcatgaccaaagccatacagaaaatgtgtccccggatcaaaccttaccggcacctgggacatcgcatagatatcctggcgcagagtataatctcccaccgtttctgcaagattcctacggactttttccatcatttgatgagtatagtcttcccctccgtatccaattcccattgccatggaaaaacaatccctgatttgtatcggcctttttgcagctctgatatatatgcctccgtcctctcctgtatccgcaaccatggtttccttccactccggaaagtactcataaaggggatcgtccataaggaaacggcctctttcaaacagcatcattgccgcggtacatataatcactttagtcgttgaaaactgcctgtaaacagtgtccggcgtaattattttctttttttccaaatctgcatagccatagtagccttcatacagcagcttgtcgttttgtactaccgcgcagccacagcccgcaggcccgttttttacatgctctttcagaaaatcatctaaatatataaaactgcccatatgtaatcctccctaatgttatcggcgctttccaacctgcaactttgataaagggggaaggagtctcctcctccccggctatccactttatcttttagtttccttcctgtgcattaatatctgtcacaattttgtctgcatttttctgagcttcctccagaaggccttccgtattatcttcatacactacctgctcaaagaatggtaccatcacatcattcagcatactcatccatccactgaaatttccgggtgcgaccgaatccgcacagatatccgtatctgtaaccgtaattgccttcagcttcggattctccatgtattccctggaattcataaccggtatatagtatgcaggataacctatttcatcagaccatctgtaaacagccgttgcagtcagatccgttccttcatttcctgtatgccaccactggataaatctctcgcaggccagtttctccgcgttatctgcctggtttgtaatggaaaaacattgtgtattggaaggaacatgctttcccccttcatcatacggaagcggggtaattccataattaatgccattgctgtccagatctgcggtaagccatgcgccagttacataaagccccagctggttagcaataaacatagtgtccatatctccttcaaccggattattcccggattcgaactgtcccttgaaccattctacaaatctttcataacccgtatttccggaaaaatgtgcttcccatatgccgctgtcattctgttctaccataagtccgccaaacatctgcatcagacacgcattagccccaacattaccataagtcaaaccggaaccataaacatgtctttcctgattcgttattttatctgcaatttctgtccactcctcataagacttaggcggcatttccggatctaagcctgcctcctgaaataaatccttattccaatatacataatagctgcttatctgaaacggtattccatacaaaccgtcatctgtagcgcaggcatccagataagtagggacaaaatcctctttatttaaagttgtattgtcccagatatcacttacatccgccaattgtccttcataggaatactttcctgcggcactgctcagaattaaatccggcccggcgcccgcggccattgatgtgacaaacttgtttccaaaatcagatgaaatatccatttccaccgttatatcccatggattgtttttattgaattcatccaccagttcgatcaatacctgtccgtcagagcctgtccacccattccaaaattgaattgttatcggttcccccgatgcttcctgtgaatcctgtgtttttacagtttccgtttctgtttttgatacagtttcctttccatcctcttttttttgcccgcagccaattaacatacttccaattaatgttatacaaagtattgctgatacccattttctcattttcctttacctcccgataaatttgctgtttcatttttatagctctttttacgtaactccttcttgtattgttaatattactttgatacattttttcccaccggtaaaacgatacaggatggatattcctcacaatgaaatattttttgttcagcctttttccctgccacttcataccctgctctgccccccgtattcagattacaatctgcatcaggaaacaggctgctggttatttccatccgcagagcatgcccttttttcaaaacaattgccgtatttccaacaggaatcctatattcataaattttccccggctccagcaattcctccttccgcccattacggtaccgggcgcgtaccagtttcttcataaggcaaaacgccgtaccatcctcccatacatcaatcagcttacatacatagtccgtatctgcagctgaagaagatgcatatatataagcttctacgggacctattatttccagttccccattcagaggttctgtcgtataaaccaatacatcatccctgttttcattaaccctctgatcctgtgtaacagcagcataaggatattcctttgtggactttatctcagaaggtacaggattatccggatcatatgtatagcaatcctccgattcgtcacccggcctatcccagcttaaacggccatcgcctttcatggtattggaatgtccctcactgtgcaaatacattttcttatagcaggtatccggaaccggccaatctttttctgtccgccattggttgattcccataacaaacagatgcaccggatttcctgacataaactcactatcttttcctttaatccagaaatcataccaatccgcgattttccccgatatgtcaattgcgtctccgccggcctcttcgccaaaatactgccccagcaagctgtccgacaatacatcaccatgctgccacgggcctacaattaatcttcctcccttccttactctttcattccctcctcttttcttaaattgcacataattatatatcgtttcatcgcgcaggaaatcattccaaccggtaagctcgaaagccggtacctgaacctgttcaaagccttccgttcttcctatctctttcagataatcaatacttgttatgttttccaacagttccctttgaaaagaaagcataggaatttcatccatacacgccgccggcatatccttcagaggccggaaacgcagctgttcctcactgtccttcagatacttcttcatcacccgttttgtctcttccgataaaacgggatggtatttttcattatcaaacgctctgccatatatccaaaaaaacaataccggagaaaagataccaaatccataaacagccggaaatttagtccatgaggtctggaatgggcaaatagcctttaaatggggtggttgtgcccgggcggcggccagctgcgaaaaaccatgataagattctcccatcatccccacatttccgtcacaccattccatggctgcgattgcttctattgtatcaaatccatcttcgtcctgatgtccggatggatccagaattccctcggaattcgcagatccgcgtacatcctgaattaccacattatatcccctggcagccagtttatgggcatgcatatatcccgacagaggattgatattatcttttaaataaggggttctgttgacaattgcaggatatttcttttcattatccggacggtacacatcacagtacaataccgttccgtctctcattgtaactggtatgtcatacaatattttaatattttctctcatgcctctccttcacccgttaaaaaaagccattatttgtattttttaatccagacagccatatgcgcaggctctgacccgtaaatgatggaatctctccatattgggggccatctgatgcatataaaccacagatacgccctcgctgggatcaatagatgcccatgtccccgaaccgccggtccagccaaattcacccggggaactattgcttcctcccgctgccggatccaacaatgtccgtactcccaaaccatagccatagccagctaaataagaattctggaaatccttcagctgccttcctgaaagctggtttttcctcatcaaatcaattgtttttcttcccattatccgttcttttttatgtattcctccattggccagcatctgggtaaaactgataaaatcctttacggttgaaaatagcctggggcatcccattctattttcttccccgggttctgacttattgtccatcatggctctgccgggtataagtgttccatcttcttttttttcataaaatacggccatccgttctttaatgtccccaaaataaatcatacccgtatcattcatttccaatggttcaaataagtattttgccagcgcatcctgtatctccattcccgttatcacctcaatcagccctgccgccagttcactgccaaaaccatacagccaatgtgagcccggttcaaaggcgatgggaacccgggaaacggctctgatttcctcccgcagcgtataatgccctttctttttcaattcttctgttacccggtaaatttcttttccagtcggagtgtcatcgggcatatgtccatacggaagtccgcaggacatactcattatatgcctgatctggatagccctttcagcctgacatatctgataagtgccatcaatgtcctttacatatttccttgtttccctccattccgggaaatactcactgataggatcatccagcaaaaatttccctttttcgaacagcatcatacaaagagtatatattgcaatctttgtcatcgaatactgtctgtacacagtattctccgtaacaggcagtttccgttctttgttggcgtatccgaagtatccttcataaagaatttctccctttctggctatagcacaaccacagccggcaggcccattctcaacaaaactctgcaataatgcatccatatccctgaatcccatatttatccccttcctttttaacctttcagtccacttgtcgccgtaccttcaacaaaatatttctgtcccaccaggtatagaataaacattggcagaatggatatgaacgctcctgcaaacgcagcgccatattgaattgtattttctcccacaaataatgcaaggccattggtcaatgtacgcatatctgtggaactcgtaatcagcaaaggccataataaatcattccatgccccatttactcccaatattattaatgtcaccatagtgggctttaccagaggaagcataactttccaaaacaggccgaattctgatattccatcaattctcgcagcttcctccagttctttcggcaatgttgtaaaggcggccctcatcataaacacactcatagctgatgccagttttgggataatcaggcccgcataggtatcgtacatacccatcttgtatacctccatgaacagagggaccataataacctgaaaaggtatcatcatcgttgccaatgtcatgataaacagcacatttttccctttaaattccaatcttgcaaaagcatatcctgccagggcatttaagaaaacggaagggattgttgtccccaaagcataaattactgtgtttattacatatttgtccagctttatccgctgcaggacagccgtaaaattctgcaatgtcagtgattccggaaaaaaatgaggcggaaaggcaatgatttgattctgcggtttaaaagcacataaagtcatccagataaccgggattaaaataataagccccaccaataccagaacacaaaacactggtatgtattgcagatttcttttccatttagcattcatactgcctctcctaattgtttttatttttaaacatttttccatacataattacagttaatactaaaatcagtccaaacaaaaattccgataaagcagtggcatatcctaacctgttctgggtcgaaaaagcgcgggtatatacatatgtaaccaatgattcagtcgtatagttaggtcctccccctgttgtagtaaaaataatgtcaaatacctgcagggaacctatcagcctggtaattaatatgaaggaaaaggtaggcataattattggaatcgtaattttaaagaactgttttattttagagcagccgtccaaatcagcggcttcatataaatccttcggcacattctgcattgcagaaacgaagataattgtagatattccgaacgtcttccatacagacatgaaaattattacataaatagtaatatcaggtgaattcaggaaatttactcctcttattcccataagctctaaaaaatatgtgaaaattcctactgacgaatgcaggaacattctccacattatagcgaccgccgttgcagagcatataatcggaaggaaataaattcccctgaatattttattctgaacactgttcttagttaccagagccgccaaaaccatggcaacaatcatctggattggaacttccactacagcgaattttacagttacccaaagtccattccaaaacctgggatcctgcaaagcttcttgataattaccaagtccaataaatttgatatcattcaaaaaaatatcggcatcgaaagtgcttaaaaagaatgatgctatcattggaataatactgaacgtcacaagcaaaatcataacgggcgcaataaacaaatatgcgatatgtgacggcttattccagaatacccgaaacctttcccccaatttcattacctttcctccctgttcattctttgctaatttgcaattacgttttagcaattataatgttaatacacatctgttgagaagtcaacgtatttttcacctttcagcagtgaaattttatctgtttcgaatgggaagccattcgtaaaacgtcttctttagataggcatcccaaaaaatccagtcatgtgaataaccttccggttcctcatatgtaagactataccccatttttaataaagcatccctgtctcttcggacaacgtcccgtataaaatcatctttcccaactgccagaaataactccggaaccggaatatgttcctgcatattgcgtttggcatactctgccaaatcatattcactccccggtatctgatccggatttccaaaagctccctgtaatttaggcagactttgtatcgttttaatctgttcaatcaggttatcggtatcaatgctgcacccaataccgccggacagatctacacatgcagcatacaagtccggcctgcgcattgacacctccaatgctccgtttccccccatcgccataccaaccacaaagttatcttccctttccggcgaggacgcaaataaggaacgtatcaatacaggcagttcttccgtaatatatgtaaaataacgaatcccatattttgtatccagaaaaaaactatcctttacctgcggagtaacagtcataacattattctgctccgcataaaattccacacggctcatcctctgaaacgtagtatcatcatcgccgccgccatgcatcaaatagactgttgggaatttcatccccggctgataacatttacgtaatttccccggttcccccatctggttttctgaaggacacatcatattataagtatactttcccgtgggataagtaactgtaatatccgtatacattcccaacacttccgaatgataattaaatcttaagactcccatttattctcctctccttttctgataaattacaaaaagaatcagcatacctcccattaatactgcaattgtctgaaacatcacttcatacccccatattccggaaatacatcctccgataacgggaccaagcgcatttccgatatcggctcctatataataggtactggacgccacacctatccgtgattcatccacacttttaatacaggccgattgcagcgatatctggccgcctccctgcccgattgctttcagtaaagcagctacaagaacggtttgcaaaatcatcgctttggaaagcaataacattgatgacaggcttaccgcaagtgagacacctacgatcatcaaaatagacgatctgtctgccatacgccccataattattcttaccagaaaaagacaggcagcgtttacggtaaaaaaaagcgctatgtttactatcccccgctcatcccccaataacaccagaaacgaactggtaatcccgtttgtcatggaaaacattcctgcagtcaaagcataaaaaaggcactcccaggcaactaaataccgaaaggaaaagtaacttttatttcttttttctgtttttgacgaatcatgacaggaactatcgtatgggaacaaaaacaacaaaacaacggcaaaagcggatataaccgccactgtataaaaaagtgcccggaagcccatatgttccttcatcgcaacaccaataaccggtccaattacctgtgaaaccacctgtcccagcccaaaatatccaagaccttctcccaatctttcttttgggataatctcggcaactaaggccatattagcagtaccgctgataccaaaagaaaatccctgtataatcctgaaaaaaagcattaccgccatatttgcggaaaaagcataacccagaaaactaaaacaaaataccactgttgctatgatacaaatcttttttttattcagcgtatcacaaatcagtcctcctaccgggcggctgaacaatgctgccatcgagaaaatacctgctattgttccggccattgcgagtgttcctcccaactttacagcgtaattagtaattaaggtcgaaatcatactgtaactcattgctgtcgttaaactgattaaaattaaaaacagatagcctgtcgtaaataatttcgctttatactgctgttcttttctcattatcagccaccatatatcctttttcttatcaatttatttccagactaccatcttttttcctgcggaaatgtttcacatattcccatccgaaatatggatccatttctgcaatttcatgacctttatcatgcatcataatgtaattatataaattgattggttccgggtcatcactgtaaaaacggttaacagaataccagtgttccgcaaagcgtcctgaagaataccggatttctgtttcatcacccggaactcccacgccacctgttactaaatttcctttttccggagttttctttacaggaatatgattgtattgcttccaaaaatcatattgatgctgctgtgtacttccccggaatacggggtatgatggttctcttgtcccatatgtataccataccggcatccgataatcatacttctctttcttactcatagccagtgccataggacggatatctgcataatctacttcggaaggaccaacacgctccccaggccaattgccatcaatcgggcagattgcagctataagctccgggtacaccatcgccgttaccattgcctgtgaagaaccatttgaaaagcccgacagatatattcttgacggatcaaccggataattgacaaccatatatttgattaatgctgctgaataagctgcatcatccggttcattatcattcataaaaatattccagctgcagcgattggaaccccatggataaacggtaataaagccttctctttctccgatttcatgaaatcctgccatttctgccgcttcctcgggattatccgacccgccatgaaaaaagagcataagcggcacttttgtcccttccggcatactcttcacagaatcgggcacaaaagtcagccatgtatggggcattccgttttggtctcccaattctgtattttcaataaagtactccccgttatatttcgctatatctgttctgtgcatcacatttccaaaacgtccggtattcgtccggcgtactttccgaaatagttccttccataccttctccagaaataccggacacatatctgcctcaggatgaatttctacgcattgtagttgattgaaaggacattcccacctgttttcatgtaatttatgagtttcatttgcacggacaaaataagaaaccgtatcttcatttgtgtcacacagccaaattggtacaggtgcataaacggctttttttaacgatttttccgacagctctcctcctattgccagtactgcggcaacattctgtggtttacaggcggccatagacaatgccatggctgctcccttttttccaattccaataaaataacgggtgtcattcatcaagtgccaggaatccatcatggtttcccatgtcggaattccaaaataagtctgcacgggttcaaattctctttccaatgtcattgccccctgcatctgatcaataatatccagatctttatcataatcccatccatcagttcccggttcagggaaagacaataccagctgcttttcctgtgccagcttatccaggccgcttttcttaaggataccttttatcttttcttcatctgcttcgtccagcaaaacagtcacgctgcatcgtttatacggtgaatgtttaggaattggcggaaaataaaggtacattgccctactgcaggactccaatgttttatacaataatcccatagtctatatctcctactttctaatctgcatttacagttactattttgcatatgttatatctcttgtataaatacaattcgcttttgctaaaagcaatttcgttttagctatatgttaaaacgaaactctctttacaagagagttctttctaaaaccatattttcagcagatatccttcacctcttttttacactatcctccagctcaggaaaatcaccgcagctttgtctgataataaaatcaggaactaatatcctgttcataggtatagaaatattattttcaatcattgtcagcatcatttctaacgcacttttggccatatccagcataggcatgcgaagagaggtaactgtcggcgtcgtatactctaaagcctcatcatcacctgatacaataatctccatatcctcaggcacacggatattattttctttcaatgccatgagaacccctcctataagtccattatccatgacaaacaaagcagtaggcgtgtctttctgagccataaaaaatttctttatttcctgataacctgattcgaagtttcttttctctgcaactccggtccattccgtccctacttctataccgaactcttcacatgcttctgtaaaccccagttcccgaagcctggatcctctccccttattctttttattgagaattcctgcttttttgtgtcctctggcagcaaaaagctttgcgcatttccgacctgattcataatcgctaatggagacccagctgaatttattggattgcctgttcattaaaataatcggtatattaaaatccattgcctccataaacgaaagatcatcttctgaagcgcctccgataatcaccccattatatctattgctgttcatgttctctctgtatttcttcaattcattgaattcatatggctgtactacaatctccacatttaacttactatttttagtaaccagataggcaccctgaaaaaatttccccaacaactcatccaaaaaatcattacaccaatacacagcaataatataggatgccttttcaccagcagcctgccttaatcttcttgcattcatattaggctgataattcatttccttagccatggcctggacacgctgctgtgttgccttggaaattctcatactgtctcctctgccgtttaaaacaatggaaacagtccccggagatagttgcagtctctcagcaatctgccgaatctggacagttgccgtttctttttttatattcatatagctacctcttttgcttctttgcaatttgcttttagcatatatgatatagtaagccatattatctaaattgtcaacttatttctttccgtatttctgtattttgcaggcgtcattccattcttctcaacaaacatatggtaaaaacttcccctgctttggtatcctgacatgactgctatctgttctacagaaagctccgtatttctaagcagcttttccgcttctgtcagcctgacatttttaacatattccgaataggtacagccactgtatttctttatcaggcgattatagtaatcctcattatagtgaaaatgttccaccaattcctgtattgttactgtcctatagttattactgatatacttctcaacttcgcagaacaaaagatcatttactttctgtttttcctgacttgtaagcataaaagcatagtccagggataaagtccttaaaagcctcgccagcagtcctttggaaatatcataaaaacccactctctgttcaataatctcgcaaagcagctgctccataagtgcaccgccctctgccattttcccccttggtacaaaatgaagaaactgttttgttcttttttgttccaaaagagcaagtgaaaggaatctttgtatttccgtattaccaatacatgccacaaaggctgaatcaaaaacttccgacggaatcccaatatataccgtaaacaggttttccgtactatatttatcactatgaaaacagtgcctgtcaactaaccaaaactccccttgtctgaacacatgatcttttccgaaaaatgactgggcggagcatccctgcacaacatatccaatctccacgaaatcatgctgatggacaggtccttccatctgtccatcagtaaaagatctccatattaccttttccccttcatcattacggacgtaaatacgcagctgatgattttccagctgcagccacatcccggcattaaaaaccggatttcccgaataaaggcacactttagtatttcctacataatattcactggaagacaggttttcatcctctatcctaaattcttctgcatgatccaatacataccgcttccatttgataaaaatttcttccatgtagacatttctcccaaaaccgttatgaccaatagtgttccaaaagcctaccccttaacgctgcctaaagttatccctgcaacaaaatatttttgaagaaacggatataccatgagaataggaatcactccaattatcatttgggcgcttttcaatccgtcttcattaaactgagagagtcgtttctgttcttcagggcttaaattagtaaagttaaaattaataataatactgcgaagataagtctgtagcggataattttccgttttcatataaatcatgccatcaaaccagctattccaatgctgtactaaggtaaaaagagttaccgtagcaataacaggcaaagatataggtacaaaaatcttccagagtattctccaatgtccggcgccatctattgcagccgcctcttccagttcatccggcagctgacggaaaaagctaagcactaacagcatgttaaaaacattgatacatcccggcagtattaatgaccagacagtatcagtcatatgcagattattcaccagtaaataagtaggtatcataccaccgttaaaaagcatggtaagaaaaaatatccaaacatatatactacgcgctttaaacttatgattatccttcgataaagggtaggccgctgtaattatcataaacaaattaagaggaagtcctaaaaccaccctcactattgttattccgaaggctttccaaaacggtgctcgttgaagcacatacaaataactgttccaggtaaaatcaactggtaacagacctacttttccggctcttatagcttcgtttgagctgaaactctgacaaataatataccaaaaaggaagaaaacacacaagcgccattaccaccagaatgccagtaattattatttgatatattttgtggtttccggattgaacaagatgaatggactgttctttaccattttcttttttcaaaatttattctccctccctaaaaaattttataatcgaattttttatctgctatataataggataaagatattaacagcagggaaacccctgactttaaaaggcccaccgctgtcgaaggggataactgtccctgttggatacccagacggaaaaccatggtatcaataatgtcaccggactcgtatactccgggagaatacagattaaatacctgatcaaatcctgcatttaaaagatttcccatattcaatataaccattagtattattatcacactcattccaggtaacgttacatgaagcgtctgcttccatcttcctgcaccatcaattgccgccgcttcataaagtgacatatcaattccagttattgccgcaagatataccacgctattataaccgaaatttttccagatatctgatattatcagggttccccggaaataacggttatcacccaggaaataaacaggggttcctccaatggaagtaattaactgattgataaccccttttgtcggggaaagcatgtctgccaggatacctgccataataatccaggaaataaaataaggaaaatagattatcgtttgtaccgattttttcaataaccgatgtctgcattcattcagcagtaacgctgttgcgatggcaagtatcgttccaatgattattttagctaccgataaaataagggtatttcctacaacctgccagattgacggtaatgaaaaaatatagtggaagttatccaggccaacccatgggcttgccccaaaaagtccaaaaccaggattgaatttttgaaaggctataataatacccgccataggaatataagaaaatacaattaatgcagcgactgacggcatcatcatcaggtgcagcgtccagtttctttttttcttttttttcagcatcatactcactcctcactgacagaatcgcgggcaaaatcatacccgcgattctcagccacctatttaccggcaacgattgcattcacttcttccgttaccttatctcctccggcagccatccaatcactaaccattttatcaaaaccttcatcaacatcttcttcaccagtaatcatttttatataggatgtgtcaataatctcctgcatgctgctccagcgttccgattgtgtcggcgtaggagccccctgataactgttccaggtgaaaatgtccggatatgtggcatccactaattcaaaacaggatccttccggaccaaacatcagtttataactgagatcaccctcctgaatatacttccaataacttcctcccacacctgtaagcgtatcgagagtaccttcatccatggcttttttcatttcacggaaaggctcaatatctacatccgcatctaacatatggattgggccggactgccaaaggtttccattctctttacaggcaaaataattttcaaaatcatttttttcaccaaacagtttttccgtataggcattaaacattgctattaaagcttccggatgctcataatcagcacggacacaataaattccattcatatcaactgatgcatataccggcgccggattaccatcagtccccggtgcaagtatcggaatccattctgcatcagggatttcactcttaacaccgtttatttgtcccgcataccaatggcagccatagaacatgcccagagaattatttgcaatcattggtccgatatcagtaaatgactgtgtggaaaattccggatttaataacccctgtacatacatttcctggagccatttcaacccgcctttcatttccggctgtaccatggaatagcctaccgtaccatcttccagcttactccagaactttttgcctgcagcctgtcctccatatgcccaaaagatacccatagatccaaataccgtataattttcatctatacttaaccctaacgtatcatcttttccatttccatccggatcctgttccacaaaagcacgggctacttccataacgtcatccatagttttcggaatctcaagccccagtttatccagccaatccttccgaatccatagataactgtatccgtttgttgacggcatttttccgggaatgcagtataatttcccatcaaacttaaagttatcaataaagccggtgccttccccttccactatactttttaaggtagggtttgcttccctttcataaacatccgtcaggtctgcgataactcctgcatctaccatctgcttatataaagcaagatcatttacatgaaatatatccggtaaatctccggatgtcatagctaaaacaagtttctgctgataatcctcggcattgggtgaaattagtttataactgcattcaataccaacttcatcacggaacatttgaatccacctgttgttatcatatggttcacctgcattggccattgctgtaaatgcatcactgttaatatcatgttctataccaaattcaacagaaatagccggactgtatgtcctccattcccctgcttcaaagcctgctgccgcatttttcgattcttccggtatttcttccgccccggaagccgcctcattcagccctttttccgtgccttccggaacgacggtactgctgccgcatcctaaaagtaccgaagcaattataaagccggccagtgaaatagataaaattttcttacacaacatttttaatcctccccttaattatatttgaatggatatgttctataagagtattctatttaacttctacaaaaacagcaatttcacatcccgacttctgtttatgcaaaatgtatctttttccgatgtgttacagatatgtagtatttctatctctattttatggaaatgagtaaggatagaattgaaaaaggcccttatgcattgaaactgcataaagaccatttcttcattcgtgggagcacatttcttaaaacaattcacataccttatactaatttataatttaattccagtttagaaaagaaatcttctaaaacataacgggaatcaattgtttcataaactctgatcagacgacctttaccattatccgtatacgatgtatcaggatttaccctttttgattgtatatctttgtattccccgcatcccggattaatagtaactgcaacagccggggaatctcctaacgaccaactttctcctgatgcccatgatgcatattcggatcggttaaacgttaccatctgctcataaagatattttcctgcctggccacaacatgaaaccttattctgcaattctgccagtccaacctgaattgtcgcatatgcagataccggtatctgccaaaatgacacctgagattccaacaccttatttactgcttccacatcgtttccaaaattaaattcacggaaatctctcatgctgtcttcatacgaacggcctccaatagataccaccgttatccgctgctctatatccggcgcctcctccaatgcacgggctatgttgcttaaagctccgagacataaaatatataatggatgagagttttgagaacgtgcttcttcaattataaatttaacaccctccgatattctttttgtttgttttaatggccactcctcaccagaaagtacatttacatccagttccattgccgcagtcaaccgcttaatcgcctcataactcttctgcatagaaccggccgctgcaaaatgctctgcaataacggcacggactattagcttcggactcatcagcgcatgcgctatggcaaaagggtcatccgcctcacaagccgtatccgaatcaataataacccggattttcttattttccggtacacaataagtcaatttcattgtcttcctcctacgatatacagattcgcatatatttgcttcttagcgtcattttatagaaaaatatagcttattacaacgctcacaaacgacaagaaaagcaaagtattgtattccaatacgactaataaattaaatcattgtgctagttaataaaaaaacttcaacataaatatgctatcctatttacagaccaatacaaataacgaaaggagtcatttttatattgaagtctcatctcttatagaagcttttgaagattttatttacttaccccccacaatcccaaatatatgttatatacatctatatctgaatctccctattttcttgaatgatatctacagatgcatgtagatattcttgttacaaaaaaacctctattccggaattatagaaaccgataatccaacaaacggaaaagaatgacgcactaattcttcagtgcgctaacccaccccttttcttctaaatataaaaaactgtgttattatgtaattgacttccagttttccttccttttaataaagtgtttatattgctccatctaaaagggatattgatatcaactatgaaatcaattcaactattctcttaagtttatttataaatcctttgggcattgtttttataatgtcttttggatcattatctgaaatttcatttattaatttttcccccattacagtaaaataaaagaaaaccaccaatatagccaaggccacaatacggaaaccctttttcatctataattcctttcataatattaatattttgatatattttaaatcataagaactttattccattcgatattttcttcgcttaatttacctaatagtacagaaaaattgcctaactcacccgagagaaaatctggtttatctccatcaatactgttaaaaaaataattttgttcatagttaatatatccaattacatctctattttatttactgatacttttatatattcatgtaataattcctcaaactaatcttttcccatatcttttaattttaaaccttcagagagtatattttcttggacattgaaaagttcaaaaaatgctcaatgatgctaaaaaactcatcatacaggaatttatacatcctaatgggagtgtccccaattccagggaaaacgggatgaacaacaccaaacaatacaaaaatgaaaaaccatctggtactttttgatgaaaatggcgttaatacatatatgacaagaatttacacttaggtacatagggataaacaaacagtttactcaatgatcctcaatacattgaaccaaattaccacacgaaaattattttacagccaaaaaactacagttaacatacaaaataaaccaatttacctcctacgtgctaaagttagatattatagagattaccaatattaacaagagatgagtgtgagtatatgtatcgtatagccatatgcagtagtgatgaaccttgcttaaataaattaaataatcaaataaccttatatcaattatattatatacttccagtaaaaaaacaaattattctgtccgccaattgcttgtttttggccgtcaatgcttgatttaagcacaaaaatttagcttctttcctcttaacaggcttatttgtaaatgcctgttatggaagtaagcagcgatgcaccggatcgcatcctcacttttttgagagaggtgatgttccgtgctctctgagatcaccggttttcaggctatctatatttactgtggaaaatgtaatcttcgaaaagggattgatggtttggcgacgttagtaaaggaacagttccatctggatccttttcaaaaggaggttctgtttcttttctgcggatgccgcaccgaccggttcaaagtccagatccgggaaggcgatgggttcgatgggtttgcctgctttataagcggattgaagccggactcctccgatagccaagaagccaggaagacgctgcaaggatctcgccggaagaacttcatcttctgttgaccggaatgacgatattggaacgttcctctatccagaaatgcagcggtactgaaatctgctgaccgaccatacagaaccaactttttctgctatactatctctcaaaaaacggaagggagggacacggcggtgacatatgggttcccattgcgtaacacagccattaaaaactgaataactgctacccttgcggaatcattaccgagcaggaaataaagaggtgtgtcgaataaactgcaaataaatacacagtttaattgacacacccttagtcaagcgaccgcctgctgtataaaatagcccctcaaaaaccgccattctctctttgttcgtcctatctacataaaactaatgccatgtaattattactcaaacaaggaaagctgacctcaaaaagggtatagcacaatgaccaatagaaagacagtggaaatttgactattttcaattttatagaatatttatagctgtctgctattgcttttacaaacttctctatattttagtgatgtttagatgcgtatacgattgctatttcacatatataccattatggtctttttaacagagccaataccttcccccgcaacggtaactttaatctcgccaggctctatgccactacgaacaattgcacaagcatgacctctgtaagattttgttcgattgtccgaataaatttcctctgtaacaggatttcccgtcccgaatccggcaagtgttgccgctccctcaacagaaactgtcaaaatgttttccgcatctgtaacgagtctctcgttctcatccaatacatcaatattgatataggcaagatcatgtccatcgcatcgtaatgtttccttttctgttgtgagtcgcaactttgaagcctctcctgacgtttccatgcaatcacggctgatttccacaccgttttgatagctaaccgcctctactttaccggcatagaacactgtgtcaaaacggactgaatttggcatcggatactccctgctcacttgctttttggcaacagtttcaccatttatgatcaactctacttcatctgccgatgaaaatacaacaacttgaacaggttttccttcataagctgtataattccaatttcttacaactcccggaaatccccacatactcatcttttctacttttccgaagcaatccggatgaagcgaataaagatatgtcttcttgctcccccaaacaacactccgataagcaccttgtggaagcaatctgcctgtaatgtcaaaatcggcatcgttagctgttctccaaggatagggagatgttgtcggcggcatgatttcccatgcatttttcgtggctatcgggtcttcggaatccacataaagagcctttccgatacccgcctctccgatataatcccatgcagtccatgtaaaatcaccaatcacatatggatgactttccaccataggccatctaaagccaatctccttggggaaattctcagacccgagcatcactctttccggatacctaatatggtcgttttcatagagttcttccatataattgtagccgacaatatccaggccattgcaaaaagcttctgtacacttttcccaaaaagctccatccagattatccgcagcgttctggctctgattctgcccctctgccaaataatcatctaacccactccaaaaggaacaaataccattactgattggccttcccgaatctaatcttcgaatcgcatcagacaactgttttgccaacgtatatccattatttaagccaccgcgttctggaatttcgttacctgtggaccaaataataacagacggatgtactctgtctctcttaataaatgttgtgagatcgtcttcccaattttgtgcaaaataggtgctataatctcctggacgctttgccatcccccaggcgtcaaaggcttcatcaaaaatatacattcctactctgtcgcaggcttcaacgagccattttgaaggtggattgtgtgtagtgcggattgcattaaatccaacctcttttaattttttcacttttcgcatttcactctcataaaaagaggctgcaccgagtagtccattatcatgatgcagacaacccccctttaattttacagtctttccattgattctaagtccatgaatagaatccacggtaactgtacggataccgaacaatgtcgattcttcatctgaaacagagtgctcggccttgatcagatgagtacgatactctccaatgtctgttgccttcgcaatcacgcgatacagattgggatgttccgcatcccatagcttggggtgtgccaaattaagcttcaatctggcagtttcccgccttcctggattgacttggatcagttgctttgaagttgcagcggcgttttcatctaacaatagaacctctacttcaactattttgttatcctgagtctcattgaccacttcaatttccgcatcaataaatgcagtatcttcatccattctacttgtctgaaggaaaattccatctgtagcaatatgtaccttcgggccatgacaaagcgtaacacctctgaacaagccgcatccggaataccatctggaactgggctgaactccggaattggtattgatcgtaattcgattctctcccccaaacgtcacatatttcgtaatatcaacataaaaaggagaatatccataatgatgttcagccaccttgcaaccattgatctcgattgtagcatgcatcataatcccgtcaaactgcaaaccaatacattcctcattccaatccatcggaattaagatctgctttgtataattacacattacaccttcaaaataacccgaatcatattttgcagccgcattaggtgaaacctttgtactgatcatcgcatcatgcggcagatcaaccctcatccccggatcattttgtatcatacttaacgaatctaaaaaaccttttcttaatgtccaattctgatccaacacaatatgctccatactcccaattcctccttgtaagtatcatacaattttcgcatatatacaacattaaacattacagttgccgctaaaacataaattcatatgctttccctgcttccagctccacagaatacccgaattcttccttttcccaggaaagcgtttcatcctggcaggaaatccgctcgggtacctcaccgacaaacagcgttctgcggctcttatccgcacggatttctgctttctgcaatgttccgttcttccattccatatccacttccaggccgcctcttgcgcgcaggcccttcacctcgccgttcttccacttaggaggaagcgcaggcaggaaatgcacccctgcgtggctctgcagcaggcattccgccataccggacagaagtcccaggttaccgtcaatctgaaatacgtttccggcattcagcaagctttccgtcaagctcttatgaaacattctgtcaatagcagtctgtgcaccttctccgtttaagaatctggcaaagaaagcaatatgccatgcaccgccccagcctgtcgctttcgcgccgtgttcaattctggagtccagggattttctggccgcttcatagatctccttatccttattccaggaaatctcatcccccggaaatactgcccacagatgagaagtatgtaccatattcggagtgagttctttctcttcccacgcccattccttcaatctgcctatggaatcgatctgattggggcgaagctctctgatgattctctcaaaatccgctttataaggactttcaatgcccagtatcttcgctgcctccagacaagcactcatcaatcctctgatgatctgattatccatagtaggtcctgcgcagatcggcgtatcggaaccgtcttccaaaacgaatctgttctccggagataccgaagggcaggtcaccagatacccttccttgtccttaatcaggaaatccacgaagaagagtgcaaactcttccatcacgggatattcttttctcaggaaatcctcatctaaggtaaaaagataatgttcccacagatgcattgccatccatgcgccgcccatctgccagaatgccgcagccgcatacatatcctgtgtaccgcagtctccatagatatcggtattgtgatggcacatggttcccctgcagccatacattctcttcgccacatcccgtcctctttcctgtaccgtatgaatcaggtcaaagagaggctcatggagtgtggacagattacagatttccgccggccagtaattcatctgcagattgatattcgtcgtatatttgctctcccagctgggacaaaactcatgattccagataccctgcaggttcatagccgtcgcgccctctcttccggcagataccatcatatatctcgcatactggaaatacattcctgctttctcgtcctcaggaagcgcaagcgtacatcttttcatataagaggtgaaatccgcaatatggtcagtcctgatatcagcatacccctttgcacgcgctgctgcaagagaagacttcacattgccgacgaagtcttcttccctgttatccgaagaagccgccagataaattacgacctcgcccgcttcatgggcaaccagcttcgcataacagtcctcaattcgtccatccgtcaccacagtcaggccgcaggcaaatcttgtaccattttcatccccttccatcatcagggtatggccattttcggtatagattctttcacatctggtcacaggccatacaccggcgctgacgaatttccccggtctcctgtcatcaggcagcctctgatccgtgaaagggacacgattgagcagcatatccagccggattgctttctccttatcgctctttaagcggatacagagtactctgtccggattactgacgaacatttcccttgtatactgtactcccttgtcttcatgggaaatgcaaagaataccctcttccatgttcaaatcagatacataattctcaccgtcggactccggcagccatcccatctggaacggaagcgcggtatttaacgcaaggttgagttcacccaggggtgagaaatttctcatattgccaggagcggataccatatgagagaacatcagctcctctgcttcttcgaacttcctgtcaagaatcagttcctgaacctctttcagatgctctttcgcgttgggattgattctgtccctgaatttgccatgccacagggaatcctcattcaactggattctgtccctggcagtatgtccgtacaccatggcacccaggaatccgttccccatgggcgttgcgtccagccagcgtgagccggcctcttttctgataaaatgtttctgtacattcataggaaacaccctgcctttcttttttaaaaaatgagggcgtccgggggacaccctcatttccaaaatgaactcgcttatttgattttattttgctgcatttgccatataagcatcataatacttctgataggtatcgatgtactgctgcacattcatcttctccagagttgtcagatactcatcccactgggtctcaatattaagatcgccagtgataaactgtaccagagcctgatttacataaccgccgatctgcagggttgcttcgctgataatctgcgcatcagggccttcgaataccaggttgggaaccagggtctcaagtgcaggctcgtaaggctgatacagctcacctgccttctgcagatagaactcggtgtcatgatccggatccggaaccttcacttcgccgcgtgctcttgcagaggaccatcttacggatgcgtcagatgcccaacgataatgcttgccgttttcaccggagtaatcctttgcatagccatttccaagccagtcatagtcttcaggaataatcagcttctcaacagtaggagttccgcctgcaagggagattccttcattggtaaagttccagccaaggccttccggaccataagactgtacattgttggcttccgcacttgcaaggaagtccagaagtgcagttacgattacaggatatttacaggtagaggaaatacttccgatacccataccgaagtagttgtcaagaccttttgtacaaagtcttacaccgtcagggccttctacaggtgcgaatacttcccagttctgccactcaccatccttatttgcccagaactcatcatcggtctgagggccgcctgcagggtaaacagctaccagaggcgtctcgttcttcagtgttgcagcgaactgtgtattgtcctgtgtaaaggtctgaggatccagaagtccttcggaatacagcttattgatgtaacaaagcgcttctctgtactcatccttcattacagaatactcaatcttaccatcgtttactacaagacctgcagcgacagtagggttggtattgctcagagggttattacactgtatgaaagagttaatcatccataccgtaggatcagaagcccagccgccaatgaaaccgctcatgggaacttcatccgcaaggccgttgccgttgggatcttcgtttttcaccttcttcaggtactcatacagttcatccgtagtctcaggaatatggccgtcgttcaatgcttctacccaaggcatatagatgtacattctgttctgataacggcagtggaaacactcattgttatcgccgtaagtatagatattgccatctgacataacgaggtctgcccttctcatggggctctcttcattcattgcgttccagttgggagcgtcttccagcaggtcattcataggaatgattaagccctgccgaccgtagtcctgaagctcggtcttggtccaaccggttgccaggaacagatccggcagatttttggggtcagtcattacaagattcagcttcgtctttgcatcatcgccgtctacatcatatacgaaattcaaatgaatattggtcttttcctcaatccagtcggttacgtaattgttctgataagttccgccgcctgtcagggatgcataaacgaatacgtcaattgtcagcttctcttccagagggaaggtaacatcgcttacgcgttcgaatgcgaagggatcgccgcttgcagcttttccgctatccgttgtcccccccgttgctgcaggagtatccgtgctgccgcagcctgccaggagagaaacgccgagcgccagtacagctgccgatgaaagcagtttctttccccataatgttttctttttcatgttttttcctccttaaaatttttataaacaacgggtctccccgattgatatataaattttcatataaatttacaattcctcttaaccctttacagaaccaatcatgacaccctttacaaaatacttctgtacaaaaggatagataatcatcaaaggcagactgctgatgataatcgttccgtatcttaacatctggcttaagaactgattctccattaccaccttcggatccactgcggaattaccgaaatccacctgagacatcagcaggattcttcgaagaaccagctgcagcggatatttctcctgggagttgatataaatcaaaggattgaagtatccgttccaaagcgcaaccgccacccacagacaaagcactgcaataatgggcatggacagcggaatagcaatctttgtgaaaaacttgaaatcagaacatccgtccagctccgccgcctcctgcagttctttggaaatcgtctgatggaagaaggttctcgccactatgatattgtaagcattcaccgccgtaggcagcactaccgcccagatcgtatcgaccatgccaagattgcggaccaacaaataagtagggaccagaccgccgttgaacatcatggtaaacagaaacagcttcatcagtatactgccgccgcggaaatcacttctggaaagcggatatgccgcaaaaagcgtaagtacgatactgataatagttcccacaaaggtatatacaatggaattcaaataacctgtccaaatagcatcatatttgaatactgtcttatagctgagcaaagtcggttctaccggcaaaaattttactcgtcctgacatcaatgcttctccggaactgaaggaacagctgactacgtaaatcaacggatacagtacagctatcgaaaataaggccagtaatatgtaattaacaaaataaactaccttatcctgtgtaatcttcttgtttttcattttccctgcctccttaaatgaatccgtcgccggtcagcttcttcgcaatcttattggacagaaggatgagtatcagtccgaccattgactggaacaaaccgatagccgtcgcataggaataatccgggaaggaggataccaaagacaccttaaacgcataggtcgggataacttccgacacagagagattgttctgattctgcatcgcaagaatcttctcataacccatattcaggattcgtccgatctccagaatcagcataatcactgccgtgggcataatcgcgggcaaatccacataacggattctctgaagcagggtcgcgccgtcaataatcgccgcttcatgctgctccatatccacacctgcaagcgccgcaatataaatgatagaaccgtaaccgaccgtctgccacactccgctccatacatatacagaagaaaaaagctgcggtgtaccgagaatattcatccccattttgtcataaaagaaacttccgacagctcctacacgggtatcgaatatcgcattcaaaatccccacaaatacaatggtagatatgaaatatggtaaatatgttaccatctgtacaaacttcttaaacttcacctttctgacataattcaacgataaggccagaatgatggcgcagggagtattcacgaccagagtgtaaagagaaatcaccaatgtatttctcaaactctccataaaattatagttattaaaaaaccgtataaaattgtccattccgaaatgtgccgcccagggacttccccagataccgtccacaatccgataatttttgaatgccagcagaataccgtacatgggtgcataggagaacactgccaacataatcaccgggaaagcaaccatcatatacaactgccaatgagctttaaagtaatggccaaaggttccgcgctttccaggctgccgagtctttactttcgttttcacttcttacctccttctctggttttgctgaattcacaatatcattatttcttcaaaaaatcattctacaattctccctgtactaccatgcaaaaattaagaaagcccgtaaatacgggctttcttaagtagatacacgcttcttttttcgatattccgaagggctgagccccgtcactctcttgaaggctctgccaaaagtattttgtgcaaggtaacccaccaattccgaaatctcactgacaggcaaattcgtattcatcagaaaatctttcgccttgtccacccgaaccgtttccacatatgtggagaaattcgttccgtaagttttcttgaacatttgggacaaatacccttcacttaatttgaaatgcgccgccacggaagccagacataattccggatctccgaaatgagtatcaatatatgccgtcacctcagaggaattcatatcaaacatgccccgatgcttctgtctgtccgcataatcgcatacctgtctgtaaagattcagggtacttataaactgtgtaatcaagggcgcattgtggttctcctccagcttcgcataatagttcctgtaatcctcttcccccatccccatacgccctatgatacggaaaagcacagactgcagttcactcagcagcatttgctgcagatacacaggaagattgttttctatgatatatttcttcataatctcttccagcgcgtcatgcagtcccctgccgtctcccgccagcacaaaatgtcccagcctcacctgcaaatcctgcggcggatacttcagcacatccccggcagtctcacgataccagataatcggattctcaatctggtcattttcatcaaaaaccatataggatgcgttctgataggattcataaacctgctccagcgtctctacccgattgccgccataggcaaaaagtttctctgcaatactgaatgagatattctccctgatacgcaggataatctcttccacttcctcctggaacaaacttttccgttctttcgcaatgcccagaagcagtaccacttgttcttcacccaaactggtatacaggctgtccggaacctccttttcgatcacttccatcagggacaggatgcaggagcacattaatttcatatcttcttcccttacatccccgggaaacagatgaaatcggaacaatacaacaccgaacaccctgtctctccattcaaaacccacgtgctccgcaattttctctgcttctccatccgccttgaaatctccataaatgagacggttcataaatgcattccgcagataagggcgctggctctcaatcgcatccgcgagcttggtattagtagccgcaaggtaattaaacgtcgtctttaaactggaaaataccgactgatgtccttcaaaatgttccgtactcctggatacctggcgcagtatatcattgatcggagtgacgcttcgcattgacatataatagctgagcagtatgcctgtcactgcccccaccagaataaatacaccggataccaacaaggtggaaaatactcttttcattaccacattctgcggcagcaattcgtaatatgtaagccctgaacggctggaaacatactttacaacctcatattcttctccgccaaatcggattttcagacggtttcccttcttttcttcctgtatctgctccctcagttccaggattttctcctgctgccatggctcctcagagatatcctgcctgaaataaagcagctgcccgctcatatcctccataaagcgaatcccgccttccacaggcacaggcagcatctcttccagcgcggactcttccatatatatctgaatcctgctgctggattctgcactcgtcgacataagcggtctctcataatagcaaagcttcaaatatatatccttttcatcttttgtatagtaatacttttctataggagaaagcccatagagaactttctcctctttcatatgcgtataccaatcttcaaagcctgcatatttgtccgcatgcatatacaggttataaaattcttcataagtatacgccgcatttttaccaataaccatttcactctggtcaaaaaagatgaaatatgaaaaaatcgactgattcatctggtataaatccggcagggaagcccgcagttcatacacccgataggtattgggatagtcgaatacattcgttctcctgctgaatccattaacgtaagaattagcagcgatagagtctcccagatactcgaactcgtccagcacattgtccaccagcacaacggcatgggaaagctcgctctcttttgccctgatatcatcctctgcaatcagggacagcatataaatataatagaaacaacagatcaccatagggataaacagtaccgcaagataagtcagcaggtaataccaaaatattttatcctgttttattttccgcaatattccaccccgtcctgcagcttcacttcttccgtttttccatttacgcagattaccagttccgtatcccgtccgggcataatgcggtaccacagcacctttccgtctttccactccatatccagagttccgccgcttcgaagtcccatgcctctcaatcgtccgcccgccgtctcagccgtcaccgccggcagaagttccagtctgtccggtctgctgtaggcaagcatctcaaggacagccgccgatgcgccgagattaccgtctatctggaatacataatcatgctcgccaagcggatgattatccatcagattgggataggtgcccatggtaaggatcgcctgcaagttctcgtacgctttccttccttctctgaaatgcgcccataagccaatgatccatgcccgtgaccagccagtatgaccgccgccgtttgccagacgcctttcaagcgtcactttcgccgcatccatcagttcgcccgtcttctcataggaaatggaacttcccggatacacgccatatacatgggaaatatgccgatgtcccggttccggttctgcataatcctccatccactccataagctgtccgtgtctgccgattttcagctttgggaagcgctccatcacgcaggccgctttcctggccttctcttcgtcaagcgcaagcaccctgcaggcattgatatagcaggagaagagctccattaaaatctccgtatccatcactgcgctctcacagagcacgccgtacgttccatccgccctctcataggtattctccggcgacatggacggggaagtcaccagattcccctcttcgtcctctatcaggaaatcatagaagaaagtcacacactgctccaacacatcaaaatgttcacgcaggaacgcctcatcacccgtatacagataatgctcccagatatgggtggcaagccaggcctctcccatcacccagaaagtggaagtgcgcccagatagggcgttgtgcaaagcagtttaaggtactgccgcacacggcagtgtgcgaaacaatctgccttaccgactaaggagaaatcctttacgggaacagcgcatggcagaaaaaggaatagtcaccaaaggacttaggtgcgactgtttcctaatgttaagaagatatgaggataagattgggtttatcgaatgtaaggttccagttcctgttttttgcaggtgtgggaaaagtcctgtaacccatgtcataacgctgtcacgtcatctttcacggcgggacaactgctacacgttatgaaacaggcgtgagaacacgtcataacgaaccgaaagcatatccgacaatcttcattcacctaagcacaacgctaactggggattgcctaagtccggctcattcgccggatatggtaacggaggctccatagtagtccgagaggggtaatgacccttacatggcgaagggagccagttagtaacatctaaaatgtaagaatgaaagggaggagaaacctcaatgaaaccaacatctgaaattttagagcgtattgaaaggtgttccagcgaacacaaagacggcgtattcacaaggctatacagatatttactccgtgaagatatttactacgccgcctatcagaaactttatgcaaacaaaggcgcaacaacacagggtatcgacgacgataccgcagacggtttcagtgacttctatgtaaaagagttaatccagtcactaaaggacggaacctacaaggctaaccctgtaagacgtgggtatattccaaagaaaaacggaaaactccgtccgctgggtatcccgtctttccgtgacaagctcctgcaagaagttgtcagaatgattttggaagctatctatgaacctgtctttgacagtcactcccacggtttcagaccgggcaaaagctgtcataccgcactccgtcagatttcttctgactttacaggcgtggtttggtttatcgagggtgatattcagggttgttttgataacatcaatcacgaaaaactgattgagattttgagcaggaaaatcaaagacagtcgctttctgaacatcattcgccagtttttgaaagctgggtatatcgagaattggaagtataacgccacttacagcggttctccgcagggtggtatctgttcaccgatacttgcaaatatctatctgaatgagctggacaagaagtttcgggaaatcgcagaacgctttgataaaccgaggtccgcatatcagacaccggaatatcatacggcaagcaaagaattaaaaaggctgtcctactggattgaccataccgataatgaagcggaaagacaagaactgattgaccagcataaagcgcagaagaaagctatgagaaatctgccctgcaaacccgccgacaataagaaatttacttttgtccgctatgcggacgactggctggcaggtgtgtgcggcacaaaagcggaatgtgaagaattaaaaaccgaaatcgctgaatttctaagcacagagttgaaattgaccttgagtgaagaaaagacgctgataacgcacagctccgaaaaagtccgtttcattggctatgatatttgcgtccgcagaaatcaggaggtcaaaggtcacagaatgaaaaacgggacgtggagaaaatcccgtaccctgcacatgaaagttgcccttactattccccatacggaaaagattgagaaatttatgtttgcaaagaaagtcattcgccaaaaggagaatggggagttccagccgatacacagagccggacttctcaaccttgcggattatgagattgtggagcagtacaatgccgaagcaagaggactatgcaactattacaatctggcctgtgactatcacacgctggactacttctgctatctcatggagtatagctgcttaaagacgattgccaacaagcataaaaccagtatccgcaaaatcatccgccagcacaaagacgggaaaacgtggtctgttccttatgaaaccaaagctgggacaaaacgtgtacgccctgttaaaatcgcagattgtaagcgtggcgaagcgagtgacatcatctatcagagaaagaaatttagctggaaaaccactatcagacaacggcttaatgccagagtttgtgaactatgtgggtgtaaagaagccgacttgtacgaggttcacgttatacggaacctaaacgagttggggaattctgattgggaaaccgtgatgaaaaagaagcggcggaaaacacttgttgtttgtagcaagtgccatgaaagaatacacaaacactaatcaatacgtcaattactaatggggagccggatacttcgagaggagtaagtccggttccgagggagggtgtaggaaacctgccgccaacggcggcaagacgcctttaccctaccctacgtgatgcagtgatcctggggcgccgtatccccgtacaaatccgtattgtgatgggcaacgcttcctctgcagccatacatcttctgcgccgtctccttgccgctctccttcacccgctcaagcaaatcaaagagggggagctggcattcgcttaagttcccgcttcctgcaatccagtaattcatctctgtattaatattgatagtgaacttactctcccacacaggataaagcttgtcattccagataccctgcagattagcgggaaggcttcccttcctgcttgaagacatcagaaggtatcggccatactggaaatacagctccatcagccccatatccctctcgcctgcctgcactctgcgcagacgctcgtctgtgggaatctgctcaagatctgcatccgtcagctcaaaggaaagggcaagcctgttgaaaacagagccgaaatcttccttgtgcaaggcgcggatatccgcttcttccttcacagccgccgttctgattctgtccagacagacttttcggtaatctgcttcccggaagctcgtctcaatatccagatagagatatgcctcctgcacatccctcacaagcaggtgttctccgatgacacgcacgaaaccgcctactgccttcgcgcaaagcgccgcagcaaaggatatcccctcctgcccgccgtccacggtaaagcaaatcgtatgctcatccaccttttccacttcatctgtggcattgtgacagcgtcccaggagacaatcaaaggaaaaagcggttccgtcttccgtcttcagcaccatcaccatacagttctccggataggatacatagctttcccgtatataacgcacgccctgcaccgtataagctacgcgggaaatgccctccgcaagctccagctctcttctataatcctgtacctcatccccatggtgcatctgcagacagcattcgcccgccgtctgataggaacgctgagaattgggcacacctgagagcgcatacatggcgagctgctgcgcctcttccacccggccttcccgaatcagctttcgaatcacgggaaggttctcctttgcatccgggttgatgcggttcagatgcttcccgctccagacgctgtcctcatttaactgaatcaactctcttgtgataccgccgtgcaccatgccgcccattctgccgttgccgattggcagggcctcatgccagaaacgcgccggtttgtcataccataatttcatagttactccttatctccccacttttaattggctgttctattttgtgaatcaggcagggattctgcctgtcattttgttctcccatttgatgctcttatttcatttttccacaagcccaggaaggaatcaatgatttattcttagataaatttgatttattctcatatatacagaattgccccccgtatgccaggatttatctggatcatgcatacgtggggctctaatctttcgtatcatccccttccagaatgaacctcgatctcccggtgagcttcaccaccgcatactcatcgttcgtcccatacctctgcctgcaagccagcacacatccgctcaagtcccgtgcaatctccgtcacatccacttcttcaaactggctcaggcagttggcacaattgccgcagtaaatcgatccatactccctaaaataccagagaatataatcccacagacattcattagtaaagcagtagaaggtcatcttcctcatcctgtccgccgaaaatgttccgactgtttattaagatatcgatatcacctaattgtctaagaccaggtttatcatattcttaaattaaaagtacttcccttttaacaaatgcatatggtatattacaagtaggattaaaaaattttgctctttctgcaaccatttaaaatgacaacaaaattttcacattattaatcatttcattcccccatattgctaacatatttagctgcttgaaaattccacattttattatataaaccatttttttgtagcaacttgaaatgattaccattttctacaatttgtccatttgatattacataaatacaatccgcgtcaacagtagaagataatctatgtgaaatataaattactgttttctcattgcttatattctttaactgtttgtttaatttctgctcagctattggatcaagagcagctgagggctcgtctagtattaataattccgaattactgtataatgctctcgccaatgcgattttttgctgttctccccccgataaaataacaccattatcatcaaattctttcgtcatctgtgtttccaggccattaacacacttattaattatttcgtataaaccacactctttagctacattcattactctatcgggagcgtaattcacagaaccagaaatattatttcctaaggctgcagcatatatttggaaattttgaaatgcaacccccattaattttctgtattgcaccaaatcatattctcttatatcaatcccattcagtaatatctgtccggcacttacatcgtataacctcattacaagctttataagtgtagatttacctaccccattttctcctactatggcaattttctcacctctttttatagtaaagtttatcctatgcaatacttcttctttagaattatatgaaaaggatacatttttgaattccagtgtttgaaacccattatttattgttttcttgcctgattttatacttggttctattgaaagaaaattcctatacttttctataaaatatccactttccattatttgagtgacaaaacgtcctaataaataatataatgcgcttaatagagtatttaccccattaaacacagcaataaaatctcctgtatttacatttttttttacaataatctgatagcccaaataaataactatcacaaaattcaccataaaatatccggataaaaacacttgtaagaaattaataatccagacttttttattcttcattctatatacatcttgtaattcttttgtattcttattatactccctcttcaatacactggaaatattgcttaacctgatttcttgtgcataatcatactgtttaaacacactttcaatatattgcttttttcttctcatgcttttaattgcattttctttattaaaatttgcttcagctaacggcttattaaaaataaaagtaacaaaaactgtaaataaaacaagaattactaatttcttatcaattatagtaaatacagtggaagttaaaataaagtttgctacatatcccggaaacttgcttagataatcaaaaattccatcaattttttcttctattgcagacatattccaaacaagttcatcataatataaaggattatcataacaagaaatatctaaagatactgccttatcattaactctatttaaaatactactacaaattctttcttttgcacctggcaatatatattctttaaaaaggctgctaaatatgagcgttaacaatatatacacgcatacaacaatagttacaagaaaaattttatttaacgaatttcctataatcaatttatttataatatatctcaataacactacattgcatataacaggaattaatgttgttataacactaacaaaaataattccgactatagctgaagcctgaatatctaataaacattttatcatatacagattatttgctattattttcttgattttcatatgtatttcccttcggcaaataattctgtgcttgtgcataaaacatggaagcatataatttatttgtcttcattaattcactatgggttccaatcccctcaattattccattattcagtacaataattttatcagccagaataacagatgataatttatgcgaaatatatataacagttttatatttagttaaatccattaacttctcatacataacctgctcagctataggatctaatgaagatgagggttcatctaatattgcaatatcaaagttcccggcatatagacgtgcaacgtatagtttctggttttgtccctcagataatatagttccatcttcatcaaatattttcgtgagattcgtaaaaataccctgtttttcattgataagcttttgcattccgctctttaataatgcagatttaataacgctctcttttgatattttaaagttgtccattaacacattctcagttatattcaatgcaaaaatgtgattactttggaaaaccactccatatctacttctataatctttgagattataatttttaatatcttgtttattgtatattatgcttccatcgttcacatcataaaatcttaataataatttaattaaacttgtttttcccgccccattgggcccgacaattgctatcttttctcctttttgtattttaaagttaagatcactaagtactttttctgagtcctttgaataggaaaaattcacattcttaatttctaaatccagaaattcttgcgtgttactttcgccactaacaactacatttctgtaattgaaataagatttaagtttaataatataaaaactatgttcgtgtgcaatattaaaagaagtaataacattattaattctctgactgaataatgttattgacgatattaatactgcaaaatcagctactaataaatctttcttaaaaattattctatatatcaaatataagcatgctccaaaaaaagcaaaataagatgaaaaaaattgtgttataaattgtaaaacagataacttaagaccgtattttttatatactcttatgatatttgttattgcattttcatagttctcttttataacggtatacatatttgacatacgcatctcttgtgcgtaatctttttgaaatattatcttttttacatattctttttctcgattatatatcgatgtttctatttgtttattaatatttatttcttttattttttttagtaatatatgaacaataagattaccaaataaaaaaattaaaacaaacggatcaatactaataacataaactactataactatacataaaaaaaggtaagaaattagagatgtcatattattaataatagaatttatgtttttttccacattttgtatcgcccaataataatcttcataaaaatctttattttcataacatgagatatctacttcttcagctttactgaatatctttttattcaactcagaaatcattttattatttagtatatccattgaataataataataatgtgcatttaataatgctctgatagtattaagtataagaataaatgttacaaaaaatatatactgctcataactattacctttttctataataattataattgttcttaaaaaaaagataccattgacaaagtccaatattacctgcataaaattaataaaaaaatgcattaacagcttttccttacaaactccccacaccaatccaagtgcgtaaaagttattttttatagcattaccctttattttcatatgtttataccgaaactcttgctctcctttcagatactttatatacatcaacataaatatcctctggcccaaaaggatcccatttactctgcaattctggatgcctatcgtaaaccattagtgtactattttccttttagatatcccatgttctgagacacttattttcggcggtattactacacttaaacgcacctggtctatgcaaactgcacctaacataatattaatatttttatatcttaacagcgcgtttattatttctctaacatcttctttggccttaccatacattacttttttctatactttggaataataacgatatggtattagtattttcatttattggtaatattgtgcttgagccttccacaactcataatactttcccatttgctccttcagaagagcatcatgagttccacactgaacaatctgccctttatcaaatacaagtatcctttcacaaaatctacaagatgagagtctatgtgaaataaatactgccgccttttcaccaacaatctgattaaattttgcataaatttctgactcagcaatcggatctagcgccgcagttggttcatcaaaaataataaatggagcatccttatagaaagctcttgcaattgcaagtttttgttcttctccaccagatatatctataccttcaacatccacattcttatatagatactgtccaatcccatttggtaaactctcagctttctcattcagacctgccatcttcaatgcatcccatacccgattttcatcataatgaactgatgctgcaacattttggcctatagggaatgcaaagattttaaaatcctgaaacactacggaaaacaactcaagatatgcatcacgatcataatcttgaatctcgattccattcagcgtgatataaccctcctgaggctgataaaaaccacataataatttaatcattgtagtttttccagaaccatttactccaacgatagcagtctggctgtttgatgttatcgtaaatgaaacattcaataatgcataatcatctgtagatgggtacttaaaacttacattatgaaattcgattatccagccatcttgttcttttggaatccgctttccttgtgaacaaatacttgacaaatcaatatattcatataaaattttcagataatcattgttacttataatctgtgacatagatacaaagagattctgaatggaagaaatcaatattacgatggctgcataactttgagacacattgcctaaacttatatatcctttaagtgcacttaaaccaataacaacatacgtaagtcctcctataaatgttgaaataactatattgctgccaaaatacatttgtaacaatctggatcttttgatcaaaatattcatccatggtatacgtgctttatccttaatttcactgacaattaaatctttttgattaaaaacacgtatatcttttgctgccttatcatcttctatatagttaaaatggtaataatctatgtaacgatttgtagcacagtttttataaagtgaaaattcctctttgctttcatttttagaattccttacagttaatgcaatacacccgattataactaaagaatataataaaccgactaccagtgaagcaatatgattagcttctcctgaagctttaataaatactcttgcaattatacctactgcagttaaaaaggagatactgtttgttaccaaacttgtaatcaaactgacaacgcttgtaatacctccgtttaccataaacatggatccaacaattttagaatgaagctcattgtatttaggatcttccatttttgcgtaatctaaatttagtttaatattattcagatactttttaagttcatgatgaaataatacattctttacatttatcttttcttgtaaataggtggacaataaattaaacatcaacgtacctgctgttgtaacaaaaacatagcggattaataactccggatttctagctccaattaattcatcaattattacagcagacatacagattgcgatataaggagttagtgcatcaagaaaagctttaaatatatttatcataaaaatattaggcgatagttctgaagttatagaaatagctctttttatcaaccttatgttttcaaaaaaactacttctttctcctttatattttttcaatcttctactcctttagcattgcatttatagtattggctttgtatttcgaacaaatttttgtatttaccggataacttcattaattcatcatgggttccaatttctgcaatggttccgtgatccagcagtatgatacggtcacagaatcttgtcgatgacagtcgatgtgaaatatagattgcagtacgatttttagttaaatcattatatttcatatacatttcctgttctgcaattggatccagagcagctgttggttcatccagaataatcaacggcgattctttatatatagcacgtgccagcattaacttctgtgtttccccaccagataagttaattcctccttcaactactgaaggtaccaattctgtatccaaaccattgggtagagatattacctttttatctaaacctgccaaatttactgctctatacaattttctcttatccatattgctattgttgttatatccaatgttcattcctatactcattggaagaaggcatacattctggaatgatgcactaatcaatctgtaatactcatcccgattatattcccttatatcaatcccattgaagagtattctacctgatatcggttccagcaatccacaaaccagtttaataagagtcgtctttccggcaccattattcccaacaactgcaagtttttcacctttatgtaccgttaaattgatatgattcagtatggcatgatcactgccttcatattgaaaactgacatcttcaaattttatttcacatggggccgtcatatttggaagctcagctccctttcctctattcatatggtccttagtatcaattagatttctataatcatcaactctataactggcattagataacccactgactcttgatacaatttgacttaaccattgtccgaatccagtaattgcaccaaaataaagtgtaaaatctccaattgtcatatcggtatggaacattctccataataaataaaaataagctcctccatttcgaacaaataccaataaaacttcaattaattgctgatatgtatactttctttgtacttttttttctaattctttagactcattgatatatttactggtgttttcattaatccaattcaccattttatagattttaatatccttggccataagcgaattactaatatcgtccaaaacatatcccagccgtcgattcacaactgctctctcttctttaacaccaatctcccattgctgtatttttattgaaacaactccatcaatcaaataggtaacaagcagtattaatataactattggattcaataataaaataaccgtactaaaagaaattagtcctagcatacttttcaaaaactctacaagattgatatagtaggatgccatgttaacatacacatttcgatttatagcgctatgtcctttttcaatcttcatttttccttcttttgaaattaccatactataatccatgtcgagagatttccagtcttttccgatgtagaaccgcatgtttaaaattcgaattgcaccaataatcacactctgttctgtgaaaaaacttgtatatttgaatataattaagactatggttaagatacctatacggaatatgaattcactactggaaatagactggccaatagaatctaatactacttttgggaaatagattactaataatgaaacaaccaattcagaaaaaatgcgtaagatccatacaaatatcggctttttatcaaatgtcaattgttccttgagcataaaccaaaaattacttaacataccgtgttgtgtattttctttatttagttgtttcacattcataactattccccttatatccctaatagttttataatactcattcacaatgctgatcagagaataaatacaaggtacttaatcttacataaagaaggtcggctggcggatgggatgtccctttggtacatctcacaaaaaagaaaagtacaaagttcccggacagttttagctgttttatgaacaagaaacatccacggttccgataactgctcctgctttcaaaaaaattaccatatcaaggcagaaatgaagccacgaaagaaattggtcgccaatacagagtccgaagtggccttccgtctagcatattttctttaactatccgggagaagaacatggcggccatgcgtatgatacactcctgtcaaagctacaagtcattgagtattgcagtatactgcgattgcccgaaatacaggatgaaaatagctcctgcttattatcgaacacctccagatcgacatggctgacaacatctgctttgaacagcgctttgttactttgtcagcagcaagcagaatcatcttattctagttattatcaataaaaaactagttcgtcaccacatccggttctccgtataataggatacattccgccgctcccccatctattctgaattatataaagtcagtgagagtaaatcagtatttcaaaattattataacctgccttattataggaagcttatttattccatactttttattgatattttcaaaatcttccttactgattctgatatgtaagtaatacggcttaacacttacctcaaatacttcgaaagaaaaagcaaaattcagccaatctcccgtttcaaagaatttacacagttcttcataatttcgttgttaaactcttatctaacacaattatttcatataatatacataatatcacagttactcatccaaatatcaatcttcgtaataatctagttccttgttgctaaacttttcaggagtaatataaataatctttatcttctcattatcgtcttgcaatattatcacattataaatcattccgtattcactcagacgtataatacttcttactcataattgcataaacgaaatacagccaagccttatcatatacagcttggcagatatggataaaatttctatacatattttgaaatcattctttattatattcggaactatacaaacgagcgcgatgctgcggaaacactgatattttggtcaaatatgattcttattattataaaagtcttaaatgttttataattccttctgattcaggtaatattgaagcaccaatcggatctgaggatagttttaaagcatattctacaaatgtattgtctttgcttctgcaaataatgagaccaatagttgttttctcttcggacaatttaacttgttcatccagtgcagtaagataaagctgcctttttccggcataatcagcatcaaattcaccaattgttaattcaatcgcgactaaactgcgtcacgttcgtcccatacctctgcctgcacgccagcacacatccaatcaaggcccgtgcaacctccgtcacatccacttcctcaaactggctcagacagttggcacagttgccgcagtaattcgatccatactccccaaaataccgaaggatataatcccgcaggcattcattggtaaagcagtagaaggtcatcttccgcagcctgtcccggtccctctccgtcaccagatccctggtaagcggatccatctcctgattgtcctggttattgtcaataaagaactggttcgtaaccacatcctgtccgccgtacagcagaatacattccgcaggttccccatctcttccggctcttcctgattgtgtcaagtcagtgacagtaatttattttgttttttctaataacctatcaaataataaaaaatttatgcaattccatacttcttaaaaatcttatccaattcccgcctgctaattctgccacttaaataatacgatttagcacttgcctcaacaacttcgaaaaggagatcaaaatttaaccagtctcccgcttcataatatttacccagttcttcaaaatcccccaataattctgttggtaaattcttatctaatacaattgtttcatcaatatacataatatcaccgttcctcatccaaataactatcttcatgataatcagatcccctgtcacataacttttcaaagatgggataaagaatcttttcatatcttgttcttataattgtctgataataccgtttctggatatctgatattactggtatatcgcaaatcatatcctgtattttatttaagttaagtgcaataactgggatcagtctttttaccgactccatacattctgaatactgccgttctccgataaaataatagggattaattctcttcccttccatttcaaaaatacatattcttcctttatatgcctctgtttcaagcaatttctcattttcaaatattgactccattttttcatcatcccatttacaattcaaacaatttccattatcataaacaggtgcaattctcttcataccattttctgatataataataccccagttactgttatttctgtcagtattcccgatgaatgcgtcaataataaacatatcccaaaaatgtcgttctatattaaccatgtctttaaagaaaggaggttctctgatagtcataattatctcatacaaatcaactccattcccattggtctcgttaccattggaatcaaaaaaacggggttcaaacgtaatctttattttatcaaattcataaggcttttccccttctgccaaaaaatctttgcatgcaactactactttgttattccttatgcccaaaattgtattatgagatggtattcccaacatttttatatttgtgatccaatatattcacatacaggactgttagaataactcaaaactatatttttcattttctgttctttcaagttttcaggatattttactatataattactgccctgatagaatattccgatttttcttccagctgtacccccatacattctatcattctgactatattcatcaaaattaattagctccataaaaaccacctcaatctttttttgaaattttatatgctcatatatacctttacagaaagtgacttaaatcaaaattctttcacatatctctatttttctcctattcctacattatttgtaaatccagacacctttttgactgttcgagacaagatatatttgcacaatctaatatatattgattccctaatctgtgctttacagagaaatagcaaaaaagcaaaaaggaagtaaccaccactggtaatagaacaaataagcataggaaggattgtctacatcttttttatttagtgaaatactcattgctgaaattttaaaccaatatgtaaattcccccaataaatatgatttgtatgttctaacttatttgtactttcgataaaatgatatagaaatcagtgcaaaaaccataggtacacaagcataccctgcattaactttaccgccgttgtagaaaatatatccggctccaacaaaggttagaattataaatatgacacttaatattaaagataattttcttatcataatctactccaacaatttcactggtcagcccgataaactggaatttgcattagtcaacgattactttaacagatgaacatttgccactattgcattggctttcagaaacactgcaagcggcaattcccaatgtgatattcaacaatgcttttaatacaattttatctccagcttcagaaataggcttttctactgtgatattaccgttagtattgattttcgtgtacataaatagattgacaggtgtaataattggtcgttgttctttgagggcattattgatattatcgaaacagtttcgatgtcctttaccattatgatagaaataatcatacatttctggtcggcaacatgggtgtaataaatcatgttcgccaacatcatcagaaagaacctccaacataggtgtatataagtttgtataaatagtatccccaatttttaattttatagattcattacagtcaatcgtcactccggttgaaagaaattcattcggtttatctgtcacttctgcaaaaaaatcaaccacttggccgccctcaatgtcaatcactgtaatattttgtccttgctgaacatcaatttttattcctgaacacgctggtattatatactctttgctcattattctcacctccaacaattccgatttatcgccctgttttttattagtatagcatatagaaatgaacaaaacaaaactattattttaaagctgatgatgcctaacctaatacaaacaagagccctcccgactgtcaccaaaccagtcgaaagggcccacacatcctcctttatttaccaccattctccgccgtcagcagcagctccacaatccctctctgcgcttcttgcgtataataaaacacttcatactcattccccttcgaactaatccgcgtttccgcctctatcccgaagtccgtcccatactccgttatcttccgcagcggcatccggttgacgaacttcaattcaaacagcccctcatccagcagcatctgctccaccgcctttatcgtcagacgcttcatcgtgccctcatcccgcaaatcgttcatctgcccaaccagatcacttaaggacatccttgccgcataatgcagctgggaagcaatctcctccgtcatcacaaattccgtcttattcttcttccccgccgaactcttcacggcaacctcgtccccgctctctaccgcatccccttcataatcctgcaccacatcataatccagactggaaaactccaccgcccccaaactgtccgtctcatcctcttccaggatgagcttcgacttcccggtgaacttcaccaccgcatactcatcgttcgtcaccgccaggtattcattcagcaagttcattcatgactgactaaccccgaccaaaggaacaccacagggctctttatgtggagctcggcatcccccaccttcccacgcagcaactcacactccctttccaattcctccacccgtgtacgaagctcctgtatttttctgtccttatcggctgccacatgtttctgtttctttgtactccgcttctgtttctccgtctttattccagaatacccacaatccacaagcatacaaagagttaacagttcagccccctcttcatcggtgaagagggggccgaactgttacagcaagagcatgaaaggacatctgcattttattctcaaaagacctgctcttcgaaaatagcatccaatgcggcttctatgttctcaagcggtgtatccgtcaggataccattgcccatcccaatcaacatacccttaccttccggattataaatttccttcatacgtcttatcgcagctttgatttcctcaggagtgccgttcggcaggagattctgtacatcaattcccgcaaggaaggtaatcctgccgccgaatgcagccattgtctcctcaggatccatgcagcctgcctgtacaggatggaatacatccagaccggcctcaatcagatattccatcaaggccgtattgtttccgcaggaatgaagccagaaatgcatccccttttgatgggtatatccaattacctctttatacagcggcagataaagttcttcgaaaacagcgggagacatcatggaagaaacctgtgtacccaaatcatcagaagaaaagataccatcaaagcccgcctccgcaaacctgtcaataatgactttatagaattctatcagcctattacccaatgcttttagttcatccattgcatcatagtaatcatacatcagattctccatgccccggatactccagaaacgctcgtggaataatctccagaaacagcccagcttatatctgccatccgcctttgagacagcttcaataacattatcaaaatttccttcttcccatggatccgggaaatgatccatgaactgatcaaattcatcccaatcctctaacagtactgccgtagactgaatgctgtggcgttctgcattcttgctgtaatctttgaaaccaaaacggtattccggattggcattaggtgacacatcatatcccggctcctgataaaacacgtagcaaatatcattcgggtatttcgcttccagttccgccagttcagccccatacttttctttcaggccaacaccccagaacttgtgcatatatgccggcaccgctttacagccctttctttcaatggcattgattacttcctgtctggttaatgcttctctcatgttgtgtcctcccttttttcaatgaaactgttcatcgttatccccatccttatgatacgtttgttttaccgataccgtagtgctaaaaaacacagtgtatgcatgctaaaggtataccatacatggataaaccacaatattatttggacaaaatataagccttggtatattttgatcatttatagtataatatagccattacatctggaggaataaaagaatgaataagataaaaaagtttaaaggattgctgcgcgatcgatatacattaaagattatcatgatcgtcatcctattcatccttttctttggtggaattgcaattttatctgtataccagacagccacacagaaaatgaaaagcctttccaatacaatttcggaaaataatcttttggatttgaaaaatattgtggaatcctatctgcagtactgcgatgatatcagtataaacttatgcctgaatgatgatgctattgccctggcaaatacagaacatatgtccccgatccaagtgtaccggcataactattcactcatacatcaactgaacaatattaagaacagcagtttactgattgattccgtttatctctactatcccgcggaaggaaaggtcatctatgatgcacaatataatgcaggggacgttacagatctaaacacattttcctgtgataatctttcttcccctgaagcttcgtattttttaacaagaaactattctttttcccgtcatatcacagttcagccgaaggatacaattaaaatagtccggcctttcccacaggattctatagaggcatatgttattttaaatatgtcagcaaaatttctccgtgatacgttatcgcgttactctatacgtgaacaggaatattttgtatacggccaggataatcaggtattacttgcttccaacaatgatccggacttcatattatcactttcaaaatatctggaaagcggggaacctattgacaataacactgtagttggcgtgcttcattctgctgaaacatccctggatttcgtttccaccattcctaccagcgtaattgtccgggaaaaccgaaccatctttctgtcatccctggcttttatgattattatgatacttgccggttttgttgtcagtattttattgacaattcaagccagtaaaccattgactaatctgttcttcaaactcaacggatctgagcgtacggtttcaactatagaagaaaaatcaaaatcgctgggtgccttatatcaatcgctaaatgccaacaatatatcactgacagaatatattgacgctaatattcccgcccttcaggaacgcttttttatatgcctgttcttcaatcgctttaaaaataatgaaaacctgttgactgccatgaaaaatgccaggatttcctttgattatcccaaatttgtggtctgccttttctcactggagtttaacggaaattccatccattccggtgagtatctttcttcctttatgtcacacgcacttatcacagacagccttaatcagctctgtccacattttgtagtgcaaatggaattatcacgctttgtgattctttttaattgtaaggaatctaccaaactatctgcttttgtaaccattttttcccaaattattgaagagcagaaaaaaacacttaatattgacattaatgcaggcatcagcgattttgcagattccatcctttctgttccggaggcctacagccaggcctgcagttgtttagattctcactcggtaaatagtcccaatggagtcgtttcgtattcagaaattagtatctcacctgccaatggccccatttacccgttccatctggaacaggaactcatggcagcgataaaaaccaagcctgattccgaaattcttgaagttttgcaggaactggaatcccactttcaggagaatcaggagttcagctttaccactgtacgttatatttatttatcacttttatccaatattaaaaagatattgtatgaaattagcaataattccgatgaatgggaaaagatagatgacttgcaattgctcccgattaccagcgttgataccatccccacctgtatccataatttaggacaggctgcactctttataaatcactttattcaggataaatccaagaataaaaaaaataataccgtccactgcattctggaatatattgagggacattacaatgaacccactttgtccacagatgatatcgccggaagtatatacatcagtaattctcatttgtatgccttattaaaggaaatcggccttacgccaattggatatttaaatgaaatccgctgtaaaaaagctgcggaactattaatagagactactaaaactgcaaaagatattgcatcctgctgtggttttgagaatactcagattttttaccggcaattcaagaaatattttaatctctctccaacccaatatcggcaattgcataaataaacagaacagtgcggcaggcaataattccaccgctctgttctgtttatttgaaaaggctttataaatcctttccttcagcgaatatattgtccgccatttacatccaacgtaataccggtaatataggaagcttcctcgctgcacagaaacacagcggcatttcctatgtcagcggtttctcccagtcccatagggaccccttcagccagtttccgcacaccggcttccccgtgggttttcatcagtaattcagtcctgataattcccggtgcgatggcattgactgtgatcccaaacggcgcgcctgtccgggccagagttttcgtcagtccaagctgacccgccttcgttgccgcatagtgtaagtgcccctttaccgcaccctgatgcgccaccactgatgatatctgaataattcttccgctgcgctgattccgcataagttccatggcttcttttgcgcataagaatccacttgttaaattcgttcggataaggttgtcccagctttcttccgtaatttcaaaaatgtcctctgcccttgaagtgcctgcattattaatcaggatatccaacctcccgaattcctgccggatttcttcaaacatacggcggacatccccgttgtcagatacatcagcccgtatttccagcgttttcctgccataagccctgatttgctctgcggtatgccctgcccccttctcatcgcttcggtaattcacaattatatctgctccggccttcgccagacagactgccaccccttttccaattccattagacgcaccggtgactaatgctgtctttcctgttaaatcaaacatatactattctgtaaacctcttttcctgtttatcccaatatacagtctggtatattttgggaatccatgtagatcttttcatctgtttcttaaattgttccggatcagcatcggccgccgcaaacattccccaatgcacaggaattgtacattgggcaccaacatgattggcaaactgaactgcatccacgatattcatattatttccatatccatttatgcagacaaaaagcatatccgggcagcccggcagggatgaaaatatagcagggtgatacaaagtatcccctgttacatagatatccaaatcatcccaggaaatccatacaccgattgccgcctcgtcagaatgtaccgcccgtatcgcatagaaatggatatcttgtaccgtcacttccgtccccgtatcaaactgaatcacattatgctgcataaagcctaattcccggacagtattccacgcatttcgggatgcaagcactgtaacttcccggcttatgtccagtaatctattcaacgtacccggatccgtatgatccaaatggtcatgagtacaaatcaaaatatcgacaattgtttccgacaaacgcggatccgccggcacaagacgtttcatacgcggattgcttttttcaaccgaatcagaaagatagggatctatcataaccgtccgtccctgatgttccagcaaaagccctccttgtcccagccatgttatccgcatcatgtagccctcgcttcccattccgtttgaaccttatgaatatccggcagatccagcatacgatactcgctgttctccgccccggtatccgcctcttccattataagaacctctgcatgcatatcgcacaagatatgatgccatatatttctcgggatcacataaatctgtccctgttccataatatgaacggataccttcagttgatcggcatccccactgcttgtgagtaaagcagcctggcctgtaagtaaaataaatacttcatcagtcccccaatggcgttccaaccttgtcagatgacggtcgtcaaagtgttccgcataacgcaggccagcaattttccagtcatgaaactggtgaagtggctgatacccttctttttctatttttaacatttttatttcgtccatattatttctccaaaaaataccgaactgtttgtggaggtcggatattagtcaattgtccggaataatgccgcaggtcatgggggatatatggatgttccatacaagcttcctcacgaagttcaattcccaatccaggtttttccggaatacggatacatccatcctggaatgccagatgctcatttgtcacatcctgacgccacattacgtcggacaccataatttccagaatttcaaaattaggtgtacaggctgccagctgtagtgtagcagcattggcgattggtccgcttggattatgcggcgcaaagggaatgtaatatgcctcggacattgccgctattttccggcattcccatattcctcccgcatggcttacatccggctggatataatccgcagcgcccttttccaatagttccttaaaagaccttcgtccatacagacgttctccggccgctattgcaaccggggatttccttctaacctccgatagtgcatccagattatccggaggcaccggttcttcaaaaaacatgggcttaaactgttccagttctttagcaatcctgatactggtcggtacgtcaaaccggccatgtccttcaatcaacagatccaccccctttcccaccgcctgacggaccgcatccacacagcgcagtgcccgatccaattcggaattgctgatattcatataagcctttccaaatggatcccatttcattgcccgaacaccccatttaaccatgtccttggctttttctgcaaactcttccggttctttggcaccggcaaaccagccgtttacgtagattttcacctgatcccgtatttttccgccaagcagctgataaaccgggacacgcaggacttttcctaagatatcccacatagccatctcaaccgctgataatgccgacattaatacaggtcctccccgccaataggcatccctgtaaatatcatgccagtgcttttcgatctccaaagggtttttaccgatcaaatactgccgcagatgccggacagccccttccaaagcatattctttatactccagagtcccctccccaacgccctgtatcccttcatcggtatccatccgcacaaatacccagtttgtgcggtaacaatccaccagaaaaattttaatatccgttattttcataccttctgctccttcaacaggaataatttcacagtccccttgggaatcagcacgcgaatctcccgctccctgctttgataaatgcctccatcaaacaaatcctctgcctgggcatccttcctcaaatgaatggcaactgtccccccctggatactgtggatcgcaatcaggcggttattggcataaatcggatccggaccttcgtaatacagatgcacccctgcgttttgtgcaattcgctgtaatatcgtatagggcagatttccggtcccactgtaatagctggtatgggaagggaatactttacaggccagtgcgcctttttggttctcagtgtaccgtccccagatctgtgcatccttgtcttcaacagcaaacatgggttcaattggtctttggaatccgtaatttccatccggaccgctgatttccgccgaagataagcggatttcttccagcgccatgtccgtgacagcactcattttttttaaagataatcctttcggatccatatagcccggggcatatatccaaagtacactctggttatttgttttgattttatgttccacaagctgccgctgttcttctgtcatataaaaagcatttaaaacaataaacaaccgatactgcgaggtattcagtttttccaaatcactgaagttataaagatcgaacggcgcacctatacgcccaagggaatcatacatattggtcaggcagtcgttattaatcccggcaaattccgagacatagtacatagattccacatctgagaggacagctatttcactgacactttccatggagaatgcctgcaatatattacggatagaaaccattttcctaacttcctccatcagttccggcgcataataatatccgccaaagaaatcaaaccaccaaagcccaatccctttagccatacacatagaaaattctcttctcaaaaccatcctcgtttcaaagctgtccttaaggcgggcattggatccgggaatatctctgccattttcaacttttgtcggtgcaatatatgttgtatgatctatctcatgaaactgcagtttccgatggagcaacacagagtctacattgttcaggaatccgcttactccttcaaaatgtctgtccctatatgaagccggcgcaaaaatcatatcaatattggggttttctactaccctctcataacccaaatgcccttcatataaaagacgggtatccggaaggggatatatatatccataatacaaacccaacagttttttatcatgcagcaagtttttaaggtaatcagcgaaaaagcaaatcgtatccccaatcatctcatgatgaaaatgccagtacaataagctctccgcatcctttaccggatcccggaatataccattggaagtatgagacaaagtttccatatccggcagacggacagatgggctgcctgtaaaagcccgatatgtactttctttcaccggatggtaccgaatcataccgtcagaagcattttggcactgggaattggtataccattcggtcgatgaaccgcaaaacatggagtaagcaaaaatacggctgccataattttcttccagatatgcaataacatcctccaaatattcacagacatctttccgccatttggaatatcccgccatctcaattaaatttcggaaggtattgctgcattccgggttttgttccagataccattgtcttgtatcaaactgaagcattatattaaagaaggcattcggggcattttctataaatagctgcatctgcctgtcaattgcctcaaaatcatactgcttttttcccttccaaatctccccatataaagaatagggaacatccagcgtacaggaaaggccggtcatgagaatactcatcagacgtacgcctgcgtcataaaactcctgaatatttcgcttttccggccgaaaagaccggaaagacaagggcggataaacagtcccatttatctcaaactgatatacaccttctttatttattattgatgcctgcatagtttccttcctattcctgcagtcttcctttctttgctgcatattctttaactgcatttgccaggcggagcgcctcttccattgtatctccccacacatcgatcaccaggctgcatcgtccttcgctttgatcgatgatacgtcggaatgtctcaaagtctgtctcctttcggtcttctctttgctgagccttaaaattattgacaagccaaacccccctgccggtaaccgcatccaggattttatctatattattaaaatccacctgcggatcgaatcctaaaaatccgtttacctgtgcaatcgcggataaattctgctcatatccccggcagcaatggaaattcaggccgccaaattccgcagcaagcttctctgcataaggcactgcgaattccttgtacagtgaaggggatagaaaggcggcgttatcatcactgacctgcatacctttaggcagtgcattaaaatgctgcgctgtaaatcccttgaaattccgtataatacctgctaaatgctgattcacttccatgatggattccgtaatgcatttcatcacatgatgaattacttcaggctcatcatacatcgcgtaaatagcttcctggctgtgcagaatactggtcagcacattaatcggggattgattgtcacagataccaatagggatttccggatattttacctggaattcttcaatacggtcacatatttccggatagaaaccatgcttttctacaggtacaatcttttcaaattcccggacatcatcaacagaacgaaagattggctctgcggacaccaattggttcatataaagaggctgtgcgccatacgcaattcccattaaataagcaacggatccaaaccccatagatatacttggtacattatccagcccgttttcagcaaaatccgccgacatctgataatcgctcaaacgactttcaaaatccagttcccgatcccggacacagtttacctgatcataagaactttgccccggacataatcccgttaccacgattttcccattacggctatacacatgggaatatttttctatgttttttcttgctttttcagcagataaataacgaatttccttcatatcatatcacctcaaacttaattcctgcactgttttggccggacagaatactctctgatactgaaaggccggaatcaacacatcttgctccttatcaacccaaatagatactgtagtatcatatccggtaggattttcaatccagatcttctcttttccttctgaccagcccgcattaacatggtcaatggcacagataatcccgttacccgggcaaacatacacccctggcaattccgcacaagtcatcataagagataccgaacaccagcaattcccataaccgactgtccctatattctccgtcccctcccaatcggaggtattgaccctttcatgcatccatcctggcggcaaaacttttccttcccgggctttgataggacgctctttcctggacagatactggggaatcgtcccggcaatctcactgatcagctgcagatatcgggaatctcccgtatagcggtacaactgtaacagttcgatcccagaatgggtacaaattccaggagcgctgtgcttgttctgcacatttgcaaacacggtcccaactgttttcatcccaagctggccaaattcactgttttccgggaagcgataattgtagggcatacaccatgttgcaaattgcttggccatttccccagcccgatccagccagactatctttttggtcacctgataaagtgtaacaaagcttgctgtcatgctataagccgattcactgtccggcgcctgcaaaatttctccaggtccgccgttggtgatacccttttgcacataatgcgtataataataatccgccatctgctccgcagtcttcccataaatagactgcttgaaaatcaatccgcacaatacaagtgcacctgccgccaaagcggcgctggaagtgtccggaatgaggatttcaccagagtctacatcaacaaactgccccaactgcccctttttttgataaagagttacaaaggcatctgcacatcgccggattccgccttccaggcgggcagtatcataaggaaaatgcttttcccggatcaccatgagacattttgcaagataaaataaggcatccgcattgcgtcggatcaacccccagtttttccattcccggtgcgcaaagctatccccaaaacattctctcccacctgcactggcataaaaaaatcctgtgggtgcctgtgtaacttccaaaatgtaatcaatatttttcaacgcccgctgccgagtcagcggactgccgttaagcagcattggatacatcatcattcccggccatcccaaaatccacgcccgttcatagccaggcctgggacccatagaataatacccatatttttcttcccaatccgtccggttaaatttttcctctaaaagttcctcacagtttccaaacggaaatcgtttatccgcataatttccttgattccattcatttctcatccggaataaggtatcaaacaggttctgaatgcctgtacattcaaattcacatgtttttacagccaccttcaggaattgcccttttgtaagtgttgcagcccggtcgtcgcttggatatccgcattttgtgatgcggtatttgttctcctttacacaaggaactgaaaatgcgatttccatattagtgtctgtttccaacaagctgattcctgtctcatattctccaaactgctgccctgtctgcaaaagaaatccctttcctgcgcaaaatactccaactaccggctctgtcatatctcccgcatgaaactgcatttttcctcccgatgtacccagatggggaatatcggtgatcatctccggattatctttttcccgttccgtatcgccatagcggaatggcggataggggcaagggtataccggaaaacggttcccgttataaacagcgccggggatcaatacataattaggctttttccattcttccaaccggcagatcagcgcgataccaatctgttccgctcttccttcttccaacgaaaaagacaaggaacgttctgtatcctgtttcatttgaagatgaattttcaacgtctctgttattgccaatttccgatttccctcttcaaatgggaaatccatagtttcagataccttttcttctttataaaaaataatccgtgcaaaccaactttgcttcatcatattgtttcctcttaagaaagtggataaagttctttaaatacattatccactttcatcacttactgcatattattttctcttttataaatcgcttctgtctgggccaaaagctccataccgccggcctcttcccatttttctttataggattcccagatttgcttcaaatcgcctgtggaagtgacaagctcagccaatgcttcctgctggatatcaaaaagcacctgattcaattctgaagcaagttcagcatcttcacggttttccacataattgattcctatcgattctgccatttctataccctgttgagtcaattcattatatcgtttatagtcccagcccttcagccgatagttaatataagtatatgcatctactccttcttgtcttgccgtagctgcatcattatatggggggatccattctgctatgtcgccctgcatttcaaaatgacgcccttcaattcccataaatgtcagtgtattcccttcttcactgcatatataatccaggagtttcatagctgcttccggatttttacacttactgctgatacaagcccaagggcctatatccttcctgttggcaactgttcctgcttttccatccggtccggcgagagccgtgtaaacaaattccggagcgggatcttctacataacgcgacagccagttctgagtacaaccggcaatatcaaagttaaatgcacccatttgtccgttccaaagcttttcgaactccgccatattggcaatagtaataaaatcaggctcaatcagtttttcatgatacagtttattcagataagccgcagcctccagatatccttcttctaaaaaggtatgtgtcatttttccatctttatacataaaacgattatttccggcaagcccataagcacaaaagatattttcatatgttctcgtatcacttaagatcatacccatcggcagtgtatcattctgcccgtttccatcaggatctttgtcacggaacgctttcaggacttcataatattcctctaatgttgttggtacttccatacctaatttatccagccagtccttccgcattacagtaaggctgggcatagaataccccctcggaattccataaattgtaccatcgatacatcccaggccttccaatatgtcttttttattttccatggtttccttaccatgctcctccaacaactcattcaggccaataaccaaaccattttgcacgtattttccaagagttgccttattgccaacaatcagaatatccgctacctctcctgatgcaaccatcaggttaattcttgtttcaaacccattatctttaggatctaccccaatcggagtaatatccaggttcaaccgtttttccagttcctccaaaatcatattttgttccggatggtttcctacggtttcatacataagagtcaaaggtaccggttcattattttccacaccgctttctatgttacttttttcgctgctctcaatagcatcctcgttgcccacaccggcatctgattttccgcagcctacaagtgctgccgctgtcatcatcactgcaagtaataacgcaatccatctttttttcatattcttatttcctctcttcctgatctttcaattatattttctgaaattattaaagtgttacctggttcccatctaccctccttccatatctgtaaattcgcagaatccaaacccgtatcctcccttcatccggcaggacacaaatattgatgatacccacattgtactgttattccccacaatgcaaaagtctgcttttcttctatttttcatcattttttacagcagctttctattataagccctttttccgggcacacctagcccttgactgagccaatcataattccctttacaaaatgcttctgcaacactgggtaaataacgagcatgggaagtactgacactacaaccgtgcacattttcactgattcttccgaaatattcatacctaataataattgggaaccgctgttcatactttggaaagaattcccctgaagcattttatataaaaactgggtcagcatttgtctatcaccgcttgttatataaatattggcatcaaagaatgcattccaatgccccacaccatatagtaaaaccatggcggcaatgaccggcttcgataccggcagaataatccgaaacagtatctgcaatgcgcttccgccgtcgatactcgctgactcttccagctcagagggaagcccctggaaatagtttttcataataaacatattccacgcactgatggccccaggtattgtcactgcccacacagaattattcatatgcagggcatcgatcagtaaataattaggaatcattcccccgttgaacaacattgtaaagaaaatgaacgtactcagcgcgttccggccaacaaaacgtttcctggacaatggatatgcaattgaagctgtcattataatgtttatggttgttcccaacaccattctcacaattgaatttccatatgcaataaatactgttttgtcactgaataacattttataagagtccagggaaaatcctcttggaaaaagaaacaggccgccggaaaaagtcagtttgggattgctgaacgaatgcatcaccacatgccaaaagggataaatcgttataataatcaccacaaacataattgcacacagaataccataggatactcggattttattttttttcatgctttttcccccttaaattaatccactttccggatctattttttttgcaatcttgtttgtaaccagaactaatattaaggcaatgctgcttttaaataagccggctgccgttgccaggctgtattctacttgctgcaatccaattttatatataaatgtatccaaaacttcgctcacttcatacacagcggggttatacatggcaaaaatctgttccaatccaacgttcaggatctgtcccacacgcaagatcaacaatacaataatcgtactccgcaaaccgggcagtgtgatatgccagatctggttccacttacccgcaccgtcaacaattgctgcctcatatagctgctggtcaatggatacaatcgctgccagatacattattgtcccataaccggattctttccatattccagaaagtacaagcagccaacgaaaactccctttactggtaaaaaggtcaggaagatttacattaataccaattgcctcaacgatccctttaaggacaccactattgggcgaaaggattgtcattaaaataccgctggcaatgacccaggaaacaaagtgcggtaaatagatagaggtttgaaccaatttcttatacctgagattcttaatttcattaatcgcaattgccagaataattggtaccgggaaggaaattatcaaattcatcaggctgataataatggtattcttcaatgctctggtaaaaccatacatattaaatagttttacaaaattatcaaaccctacccattcactgcctgaaaaacctttaaagatattaaagtccctaaacgcaattgtaactccatacataggaaggtaatgaaaaatcaaaaagaagagaataccgggaagtgcaattaaatataatccccggtccctgttgattgtcttcaggttttttttcagtttcttccctattacattactcataagctgaatcctccattcaatcatgcataatttttctaaacctccggattcttaatattgattattttgttttccgaaagattctgtatttgtatcgcaactacattgtacggtgattctgcacaaacagatagtctgttttcttccatatatcatcatcttttatcaaaaatagcgaaaccggcagttttttatactttgaagataggtattattttttattactgctattatttatattaatatataaataaaaatcaaaaaattgttgataaaaaaactcctactcaattgtggtttactttagcatttttattttttcagtataaaaagttatttttaaaaagaatttattcgcgtgacaaacgcaggaataaacagatatgaactttcagaaaacaaaaaatagaataatgtttaattttacaaagtatccgtaaagcagaacgattgcttcccagattcttaatacctcttcatgaataagaggtaagtccctttcttcgtacttctatgacaatctgtaaataatttagataaaaaagcttctctcatcataacacaagtttttggcagcatcttacgctcataatcaaatacagcttttacttcccatactccatgatatcccccgtatagagcatatgcctcttctgttacgtccccttctgtcatttttatccggaacccttcgttttaaaatacatttcttatctttcaggcactttcagataggactgtatcatgatatccactgctttctcatagactttaccctctgtttccagtatatgtattgacttacgtatggtttttggtgccccagttgtttttcatattctgtttctatttgtacatcaggaaatggcagataagcataaataccgctatttttattgtttttgcattatatttcaaatgctaaaactgattaccagaaaaaatccacttcatgtgacattgcattaatagatctgctttttacaacaggtatacgaatatccgaagtgtgctgcctaaaatatgaacaatttgatttctatggacgttcaatacgtattggggaaaagggaagaaaagaacgaatcattacattcgataattcagaagttattcaatgtttaagaactagtttttcattttcctctaattcaattgcagatgaagccgccgcattctaatgcgccggctccatctagcaactctcttactattatattttcttctaagtaacagttattttatcttatcctgagcatactgtccttaattattgcctgaggacaatacacttgtgtaagacattccaaaaggatcctgtcccctttatcaattttaggcgcacataatatttcaagctcgtctaaacattcttctctgattttcagaaaatagtcgtcctgagcaacattaatattatttcttactctttcacccattctccttttggtcagtttaggttctttgagcatatcctttaaagaaatgggcataaaatacaacagatatctccattctttctgaaattcccatgaaatatttttattttttcctaatttattaatttctatataatatccgatatgaattccatgctgaacttcccgtcgcagattcggatacaacagttgttcatcatctgtataattcactttatgaagtatatcatcttctattaaaggaaacatattttccctgtataaatctttttggggaatataactggttatgatacttcccttctgcaaaggatcttcccatgtgtagcgttcaaagggatttacaggtaaacgaatccttacaccatccatattagagtacatattccacataggtatggattcttctttttcactggtccacgaacttacaaaacaatattgtccggctttactataatccgcactgaccaactcattaagatcatccacatttttcaaagaattcagcctgatagtcctgtttttcaatattcgggccaaagcacttaaattcgtataatgatatagataatccatttctacccctccttttccttatttattccataactcatagtaaattttctctgttacagagcttaagaatcgctgttattatcagctgtcagcagcagctccacaatacctctctgtgcctcttctgtataataaaacacctcatactcattcccctttgaactaatccgtgtttctgcttcaatcccaaagtccgtcccatactccgttatctgccgcagcggcacccggtttacaaatttcaattcaaacaacccttcatccagcaacatctgctccactgcctttatcgtcagacgcttcgtattgttttcatccctcaaatcattcatctgtccaaccaaatcacttaaggacatccttgccgcataatgcatttgggaagcgatttcctccgtcatcacaaattctgtcttaatcttcttccctgccgccgtcctcacgacaggttcttcccatctttctgccctttccccttcataatcctgcggtacatcataatccaagctggaaaaatcaacagcccccaggccgtccggatcatccgtttttctatattccttactgaaatcctttacgcgctgaagaaactgttctccgtatttttcaaacttaaactcaccgacaccaccgacagaaagcatttcatttttatttaccggtctgataacacacatatgtaccagcgacttgtccgaaaaaacgatataaggtggcaccccttcttttctcgcaatctccgcccgaagactccgaaggctttcaaacagcttttcatcctcttcgtccagattaaagtccgccgcccctcttcctttcttccctttcttttcagctgcctgcttcggcacacgttcctgctccttagccattttcatgattattgtttcgttctcttccagaatatcttttgactttccagtaagcttcacaatagaatattcatcattggtaacagccaggtattcattcagcatcagataattcattacctgacgcagcttatagataggaactgtggcaagttctccataatggggattttcatccattcgatattgtctgattttggcagtcttggctccacgcaccgtatccagtattacattggtaccatacctctgtctgcaggactggacacaaccaatcagaaccgctgcaatttccgttacatccacttcctcaaactgtgtcagacaattactgcagttaccgcagtaattaccgccgtattctccaaaatagcgtaatatgtaatctctaaggcattcattcgtaaaacaataaaatgtcattttgcgaagacgttctctatcccgttccaggacaatctcccttgtttcataatcaagttccttattttcctggttattatccacaaatagctgattggtaacgacatcctgtccaccatagtaaagaaggcaaacgcccggctcgccatcacgagaacatcttcctatctcctgataataggcttctatacttttgggcatattgtagtgtattacaaatcttacattcgatttatcgattcccattccaaacgcattcgttgcaatcataatctgtgctctgtcgtaaataaaatcatcctgattcttttgtctctcataatcactcaggcctgcatgataacgggtcacagaaaaaccgtcacgatcaagcttcatactaacttcttctacaagctttcgtgtcagacagtatacaatcccgcattgatccggatggagcgaaacaaactcccgtaaagcggaatatttatcttttggcgattgtacatccagatataaattgggcctgtcataccctgtagttgctataaacggagcttccaattccaatatattaacgatatcctcacgaacttcctttgtagccgtagctgtgaaggcactgattaccggcctttggggaagcatcttaatgaaatccacaatcttgagataactgggccggaaatcctgtccccattgtgacacacaatgcacctcatctattgttaacatagagatttgcgtattcacagcaaattccagaaacgattctgttaataacctctcaggagctacatatataattttataccggccttccttagcaaaagaaagcgctttgaaatattggtttgttgataaagaactgtttaaaaaagcagcatgtactcccgcctgattcaatgccattacctggtctttcataagagaaataagcggggaaattacaagtgtaataccctccatcattaaagccggcacctgaaaacacaatgactttcccgatccggttggcataataccaaaggtatctctgccctccaaaatactattaataagctcttcctgtccttcccggaagctgtcataaccaaaatactgctttaatatctgatttttatccattcgttcctccaaatgaaaagcccgccgtatccggccgccccttcctttttccgcctattcttttctccgtcatcttcggaattccagggagatttttcttcaagactcacataatccacacatgacaaggcccatggcctcaatagaaatttgatatcttcatcctatcacaactatacacggttacgcaataaaaaagcgcctttttatccgcccttttccggttcttcctccaccatcatccgtttacccgtcttttcacatcgcctgccacaaagcagacttctcgtccattccccagcctttgcagacatccacccattccccggttccggaatacgtttccagttcctccatggtcagttcaatagcgctgttgctgctgccgcaggcaggaaacactgtatggaaccgtttcagggattcgtccagatatatcttaacgccttcgtttaccgcaaaaggacagacaccccctaccgcatgcccgattttttcttccacttccgcggccggaatcattttcgcctttgtcccgaacctggccttatatttggcattatctatttttgcgtctccggctgctacaacgaggatgcacccgtctcctgtctcaaaggacagcgtctttgcaatcctgctgccttcgcagttaagcgcctgcgccgccagttccaccgtggcgctggatacctggaattctctgattcttccgtccgcattccactgttttaaatattctcttactttatcaatcgccataatctgccttcctttccgcataacaacctttattttattacaatgcccatcagctttgcaagatctgcggcctgataaatatccgccacagcccctctgagttcatttttctcttccgacacgataataccttccacatcgttgcccctcagatccatccctttgagcgacgtatggaaaaaactggccctcttcaagttcaaatccttccactccacctttttaaaacggcagtccgcaagatagctttcctgcatatcacatccggccaagctggcggattcccatctggatccgctgaaattggcaaaagacaggctgcattcctcccaccttgtttctttcagaaggctttcatggaaatcggtgcctacgccttttacaaacaggaattcacatcggttaaaataacaatcatccagaacgctgttggaaaaatcacagtttctgaactgcacatcaataaagcttgccttttcaaaattacaatgaaaaaaggaacagttttcaaaaaccacgccttccaggttaagcttataaaaatcctcattttcggccgtcagtcccctgatgcggcattgctccacaagtatgtcttcccggcgcgcatcctgcagaaaggcaagaccatcctcaatttcccgcagcgaagccgataataccggcggcgctgttttcaaactctttttttccatatccggttcctcgtatgtttttcttattcaggctatatatttctaattgttaagtctatcacagtctgcctgaaagggaaagaccgcatccaaaaaaggatgtggataaaaaacaatggagccgtccctgccctgtctgtgcctgtacttgccttcctccccgcgcgtctgccgtcctgcagggttccttagaggggacgcttccgctcggataatcacgcaacggtactaaggctgccaaaaacgcagcctaaggaccggcgtgtttataacgccccttacaggaatccctgcaggacggcagacgcgcggggaggaaggcaagtacaggcacagacagggcagggacggctccattgttttttatccacactcacaaaaagcgccccgataaaatcaatgctttatcagggcgccctgctttggaggactatatcagaaaatatggaaactgatttatttcccagccggccggcgtattccgtcagccatcaatggaaatatagttgtggtcttccacagcctttttctcttctgtcttgggaactgaaagcttcaggataccatgtttgaaattcgccctgatatccgagcgctctacattttctcccacatagaaggtacggctgcatgcacctgcataacgttctctgcggatatatttgcctttcttttcttcttccttatccaggcctttctctgcactgatggtgagatagccgtcctccagctccacctggatttcgtctttcttgaaaccgggcagatccacatccaattcgtaggcagagtctgtttcacggacatccgttttcatcaggcgtgccgcattttttccgtacagcggattcttccttccaaaaaactccttattcattcttttttcccatttatcatcaaacgggaaatccataaaatcgtcaaataaattttctccaaaaatgctgggcatcatcatatgtcattcctccattctttgtatcaatcctgtcagatacgatatggttttatccttcgatggctatatacttattctcttctaccttgggctgtgcttcttccttcggtacggtcagcttcaggatgccattttcaaattttgctttgatatcctcctgttttaccgaatctcccacctggaagcttctgctgcaggatcccatataccgctctcttctgatgtatttgccattttcgtccttttcatcgttgtctttcttcgtggaagcgctgatggtaagatagccatccttcaattccactttaatatcttctttgctgaaaccgggcatatcgacatccagctcatagtgtccatcattgtccctgatatcggtcttcatcaggctgctttcattgtagcttccgaacgggaatctcatccagtcatcaaataaatcttctccaaaaatactaggcatcaacataatcaatcgctccttttcgtaaataatatagttttgtttacaagtttggaacgcgggtactgactttggtataaaaagtaaccgacctctttcggtgtatcatgctttttgtatctttgtctttatgtctttccccttgttctacatgtaatataacacgcattattagcagagtcaagaggtgagtgctgatttaattataaaaaaagtataaaaatcgcgtaaatgaagcgatttttccaaagaaataacaatcaatttcccttgctgactcgtctttcttttattttctgcaggcccaatacaatggccagtcccgccagacaggctattatattgaagttggaaaagctcagggcttctttaggtaccgataaggtcgtcggccccatgacaatggcgtacagcgaaccgagcatcattcccagaataacaaatatcgtttgggggcggaatttctccaggcatattttgattattctcactaccgataccgcgccaaatattacgccgcagccgaaaaacagcatggaagggatataggaaaaatggaaatgcagaatctcttttaccgccgtaactacaggcatataggcgccgaacaccagcagcagcgtcgatcctgatattcccggcaaaaacattgccgatatggacaccattccgatgagaaacagctttatcccctccgtcaaagaaaatacagataaatccatgcctgccgattctgatcggctattataataggtaatcagagcaacaacagcaattcctgccaacaggcagagcacattctttatccctattttaatattctttttttcttccgatataataagaggaatagcgccgagaataaagcctatgaataaagaactgacaaggtaaatcttgctttcaaataatgaggaaagcacaagcacagcggcaatcatacccgccgcccatcccacgccaagctttaataaatatttgaggccttctgccttttcttctttttttccgaacaccacattattgatggatgctataaagtggtcataaaatcccattataaaagctatcgtaccgccggatactcccggcacgctgtcagcaagcgccatgcagacgccgttaattccttcctgtatcattgttttttcctttctgccattgattcctaataggattcccaaattttacgaattttatcttccctgtaatcgactcgcatgtattctttttatggcagaaattgaatcactaaaaaagatccgatgcaaatgcacccgatctctttaaaataactatatacaaaataaaagccgctgcctgactcgcgaaatcatagcagcataagcaatgtacctgccactatcagaactaatcccgacgctgatttccggttcagcttttcatggaataccaggtatgcaaaccctatcgtaatcagaatactgagtttatctatcggaaccaccacgctcgcaggccctgtctgcagcgccctgtaatagcacagccaggaacctcccgtcgcaaatccggagagaatcagaaagatccagctctttttatctatgcttcgtatcgtattctgttttttagtaacaaacacaacaatccatgccatgatcaatacaacgattgtacggatggccgttcccaaattggaattaatcccttcaatgccaaccttgccgagtatggaagtcagactcgcaaaaacagccgatccaaaagcgtaaataagccatttgccattctgctcccctgtcccttccgttttcttcttttcaatcatcagaaatgttcccacggcgatcagaacgatggctgcggccttaatccatgtaatcccttccttcagaaaaataatcgctaatatcatggtgaggattgtatttgatttatctatcggggtaaccttattcacatcgcccagctgcagcgccttaaaatagcatagccaggaagcccctgtcgcaattccggaaagtatcagaaatacaagggtccgtgtgctgacctcggaaagccctacctgggatcccgtaataaataccataagccatgaaaaggcaagaacgacaatggttcttattgctgtcgcgacgttggaatctatgttcttaatcccgcactttgccaaaatagctgttaaacctgcaaaaacagccgaaccgaacgcaaatgctatccacataagcaaacctcttttctcttattgcccttccgcttactttgccgtccttttgctttatacggtattttaccggcttccgcgttccatatattctgtcatatacgccctgattttacggaactgctcccttgtgaccgggttctgcgactcaaaatccatcagcttcagcagatatccctgccttttcacaatctgcctgctttccggaaactgcagctcaaaaaccagggaaatatgtcccaccagatgatccgcggccgtcctcttcaggctgcgcaaaatggcatgctcctcgtaaaaagcctccattacggcttccgaaaccggacagctcctgagttcctgtgaagatacattataaatttcctccggagggaaatccacattcaccttcagaatgtctattttatccgcatcccgcaggatatgacagaacctttccgtcctctcatccggcatatcaggaatgcggtacgcgctgtgataccgtaccgcattccaaagcagcgtatcttccgatgcatcctctgtataatccctgatttttccctgttcaaaaaggatctgcgctccgtattccgcgtgatcaatggaatcggcatctataaaggttccgtaatttttcagctgttcgaaacggcccacatcatgaagaagcccggtaaaccaggccagatcctgttcctctttttccagctccagtgacctggctatctgttcgcacagtccggccacccggaaggtatgctcaattttcaaacggactttttcttcctccgcattataatggctcacgtaatcacgaaaagctgcttccgctttccctctgtctatattcatgtttccttccttttctggctcagacactttttcccgtctttatcaaaagctttatgcagcgctttttccgtgggtgcaacaacaccgattaaagggatcatctggataaaacaaagcacccctcccacggttcccaccgtatcctcgccttttccatataaaaacaggaaaacaaccagggtgatggcacccgtgacaataccggaaattttccagatccttcccatataatgatgggcgaactgccaggtatcctcatttttcatggacatggaggtcctgtaaccgaccaccgaattgatctcccgcggaggcctgctctgaaatctctttccaaagccaaacatacatatcggtatcagtaaatccatcagaaacatataaatccagaatcccattccttacaccgccttccagtctgtcattgtattcatgcgcacgctaatctgcattgctttgcttaatactgtcatatgccgctgatgccggaaatactttgaacttcatctggttacatcacctcgacaacctcgaagcgttcaaacgtgatgggcgtctgatcgttaaaagtatagcctcgcctggcggcgtcccgtgtccaatagcgtatattgcccgccttccattgttcaaaggtttcgtcctcaccctcaagctttaccatatcccaggtcaggtcgcagaacttcaccgtttcaaggtgcacagtctttatcacacaggccggattgccgcgtccgtcaagtaccagtgataaatcgcccacatttggtttctgatcgctctccaatatcaccgaaactgttgccgttttctttccggacagtaccagcgccaaaagttcgtctgccatttccgggctgtcgccaaaggcaaagcgttcaaaatagtcattatttgtattttccatcgaattcattttttatttaatcctctcataaatgatacttcgtcattccccgctatccgccaaaggcagactgctcattttctgttatagctttaagcttccatctaaggagaagccgtaaccggccgggaaaaactatttttatcatacgcgatcctaaattccttgtcaatgaaaccaaaacaggcttttcctttttccgccggaaaagcctgtacccgaaatcctgtgaaaccagttatcccttcatagcttaacactctgccatttcctgtcacacggcaaactggctgttataaagctgtgcataaaaaccttccgccttcagcagttcctcatgccgcccctgttcaatcaccttaccgtccttcatcaccagaatcacatccgcctcccggatagtggaaagacggtgggctacgatgaagctggtcctgccctccatcaggcgggcaaaagcctcctggattttcatttccgttctcgtatcgatagaggatgtagcctcgtccaggatcagcatgggaggcaggcaaagcataacccttgtgatacaaagcagctgcttctgcccctgggacaggcttcccccatcctccgagatcaccgtatcatatccatcagacagacgcttaataaagctgtgggcgtgggacgccttcgcggcagccacaatttcttcctccgtggcatccggttttcccatcacaatattttcccggatggtccccgccttcagccaggtatcctgaagcaccattccgaatcctgtgcgcaggctctttcttgtcatatccctgatatccgtaccgtctatccgtatttcaccgctgtccacatcataaaaacgcatcagcagattgatcatggtcgtcttcccgcagccggtagaccccacaatcgccactctctgcccgggctttaccgccaggttaaaatcctcaatcagcctctgttccggcgcataagaaaaatacacatgggacagatttatcttcccctgaaacgcattggccaaatccactgcgttctctttttccggcacctgcggctcttcctcaatcaaatcaaaaatccgtcccgcacaggccagggcattctgcagctcggtcaccacccctgaaatctcattaaagggcttcgtatactggttggcatagcttaacagacaggacaaatcacctacgctgatccgccccgcgaccgcagtcagagcgcccaccaggccaacacctgtatataccacattgttaacgaaccgagtcgccggattcgtaatcgaagaataaaaaatagctttcagggagcatttttccagccggtcattgatttcatcaaactgctccattgccttctcttcatggctgaaagcctgcaccaccctttgatttcctatcatctcatcaatcagggatgtctgctctccccttgtttccgactgcagccggaacatggtaaacgtccgcttcgcaataaaagccgccacaaaaaaggacagaggcgtaatcaataccaccacaaaagtaatccccacattagtagccagcatgaagagaatggttcccacaatggtcatcacccctgtaaacagctgggtaaaacccatgagcagaccgtccgcaaactgatccacatccgcgattacccggctgacaatctcaccataagaatgactgtcaatatatttcaaaggaaggatttcgattttccggaaggcttcattcctgatatccctcacaatatgataagtcattttattattgcagatattcataatccactgggccagcccggtaaaaacaatagcgacggcgatctgctttaaaatagcaagtacagcaggaaaatccaccttccccggcgcaataatatgatcaatagcccgccctgtaagctttggcacatacaaagtcagcgccacgctcaccgcggcaaaaaccagggaaagccccagatagaaccaataaggcttcagatagcgcagtaccttgacaaacgtatctttttgtgcagttattttctgttttccctttgccatcttaagcctcctttgccttctcaaactgggaataataaatttcctgataagccggacagctttcaagaagctcctcatgagtaccgattcccgccatttccccatcatccattacaatgatctgatccgcataacggatggaggaagccctctgggaaacaagaaacaccgtaggactgtccttcatttccctgacagccttacgaagcctggcatccgtggcaaaatccagtgcggaggcgctgtcatccagaatcaggatttccggcgacctcaccaaagccctggcgatagtaagacgctgcttctgccccccggaaagattttttcctccctgggcaaccggcgcatccagccccccttccctggtatctataaattccctggcctgggaaatatccaacgcacggtaaatctcctcatccgtagcgtcctccttcccccaaagcaggttttcccgtattgtccccttaaataaaaccgccttctgcaggacaacgcccaccttcctgcgcaattcctccagactatactcccttacatccttcccgcacaccagcacccgtcccctggtagcatcataaaaacggggaatcagatttaccaaagaagattttcccgaaccagttcccccgataaccccgattgtctgccccttatatgccgtaaaattaatatccgtcaaagactccgccccagcattcttataggtcagccccacattctcaaaccgcaccgccggaaccccatcctgctgtgccgccctttcacgagacagctcacccccctggaactccccgcttccatgaaatgcttcgcttccacggaatacttcgtttctatggattgcttcgcttccatccttcccatcagaatcccccggatccctcatactcgtctgaatctcaaaaataccctgaatccggttcccgcaggctatcgccttagtaatcgtgataatcagattagccagcttaatcagctccaccaatatctgagacatatagttcacaagagccaccacagccccctgcgtaattatcccgccttccacccgccatgctccggtccaaatcaacacaataaccgcgccattaataataatataagtaacaggattcatcagagcagaaatcttccccacatacttctgcatcgaagtcagcccatcattactctcctcaaaccgggcgatctcactctcctccttattaaaggccctcagcacacgcactcccgtcagattctccctcgtaattcccagaaccctgtcaagtcctccctgcaccttcttataaagaggcatcgtaaccatcataataccgaagaccaccacagaaagcaccggaattgtcaccacaaaaatcaaagccgccttcacatcaattgtaaaagccataaccatagccccgaacacaataaaaggcgaacgcagaaacagacgcagcaccatattcaccccattctgcacctgattcgaatcactcgtcatcctcgtaatcaacgtagaagtcccgatagtatccatctccgtaaaagacagcccctgaatatgagcaaacaaagcatgcttcatcttcgctgcaaacccaaccgccgccttcgcagcaaaatactgagccgtaatcgaacacaccagcccgaccacccccagcattatcataaccaggcacatcttcccgatataccccctgtccccattaccgatacccgtatcaataatagccgccataaccaaaggcaccaacaactcaaaagaagcctccaacaacttaaaaagcggcgccagaaccgtctccttcttataatccttcaaataaacaagtaatttcttcacaccctcactccttcaattcccagccatccatgcagaccctgtcccaaaacacacaagctatcccaactaaccagcccgtccgcccgcatcatccgccactcaacaatatccttgccaaaattcctcatctatcgtatcataaaatcaaatatatgaaaattattatatttatatataacccatatctttttcatatacttacttttatagactttatatctcaacctacactgattttctttacagcttcgtgaattcctgccatctgccgtccgcatagcggagccccgggccatgccgtgttccctgacgggaccttctaaaaacgccggtccttacgctgcgtcctttgcagcgttagtaccgctgcgtttttggcagagcgaaagcgcgccccgccagggaacgcggcatggcccggggctccgctatgcacacacggcagatggcaggaattcacgaagcgcccacccccagagaggccaccccccatggatttaaaacaactaacctattttgtcaccgtaataaaagaaggcaccatctccggcgccgccagaaaactgaacctctcccagcccccgctgagtacccagatgaagctcctggaagaagaattcggctgcatactattcgaaagaggatcccggaaaatacagcttacggaagccggacagcttctctatgaaagagctgtcaccatgctggaactgtctgaggtaaccaaaaaagaacttctggattaccgcaacgggctgaccggcgcgctccggcttggagtggtatcctctgtgggctgcagcctgctccccgaatgggtgtccgccttccacagcgaattcccggcgatccgtttcgaactgtatgaagcgaatacctatcagctgctggaacagcttcgctccaacctgatcgagctggctatcgtccgcaccccttttcacggggaagaattcgcctgtaccacactccgccacgagcccatgcttgccgtgggtaccgaagcctgtttttccgatgtccgcggcagcgccggttccaaccttcccgactgcgccgatacctccggcatcctcctccgcgataccatatccctgcaagccttaagccgccttccgctgataatctaccgcagatgggaagcccctctgcgtgaagccttcgccagggaagggctttctccctcctgcttctgcatgaatgatgatgccagaacctctgtctactgggcggacgccggcctcggcgtgggtattgtgcccgcctcctcccgtccgctcctgcgcaatccacagacaagagtatatgaaatagacgacagcggactctttaccagcatttccgttgtccacaacaaaaatgcatacttgtccactatcgccagaaggtttttaacacatttacagaaattgcagtaactcctttagactttttatttccttatcaatccgaagctccaaagaacgttcctttcccgacggattaaaccagcagcaggcaacccccgcgttgttgcctccctggatatctgaggtaagggaatccccgataatcatggctttttctttttcaaagccgtcaatatgggcgaagcaataatcaaaaaattcattctgaggtttctgatatcccaccgcctcggacacaaaaatatccttcataaaacgttctatgcccgaaagctttaatctgctgcgctgggttgcttccaccccgttggtcaccacataaaggtcatattttttataaaggtattccagcacctcccaggcatcctccattaattcatgcccttctcccagtagcagctggtactccttttcaaaagccgctccatccccttcaactcccatactttcaaacagtctgccaaaccgtgtgaaaagcagggtctgcttgtctatttctccccgttcaaaggcttcccacagaccatgattaatccgggaataaagcttataggtgtcttcgtcggcctcatagccgttattttccatggcccggaagaaagcggagcgttcagccgccctgaaatccagaaaggttccgtccatatccagcagtaatgttgtgtattccatatcttttctcctgtcctgttcccctgtaatccaacataaatgaagtacgcatcctgaagtatgaatcgcagattctattatacaatttatgtgaattacttggaagaactattttacgggacagagaatacccggtaatatcatcctgtcaaaacagccttttgccatttaatatattaatatccagttctttcgccataccggtctgcttatacggatttattttctgcaccgcgccgtcatatttaaaaagagaacctgtattcttgaaccagaaggtaacatctgcctttacgcactgctcacggatatccagtacccagtcataatcgcattcgcgggcatcccgccccgtttcccctccgacggaaacatgctccactccgtcaagatagggcgttaaatctatcgcttccaaaagcggcgcgcaggcaataaaccgacgctttatcggataggataaaaacaaaggaagcctttcatcggcttttgcctggttttccacggtgcacccgatattcacattgtcataacccccgccccagtcctccggaagtgatacaaggaaacggtctatcctctttgtcaggatcaaaaaatcgatatccgtcctttccctgatcatagcccagacttctttccgccattcatccgcttccggcagaaaaaaatcagtagcaaagcaggtggcaagaattttgtttcctttaatgttgtattcgcccttcgcattccttcttatcggccagtcgaatttatccgttttctcaacgttgttttgtccatagcgtttcgcatgcggcccgtaaaaataacaatttgtacagccgtcacttattttataacagcctgtccatggctcccaattcataagcactttcctcccttttccggatgttttcatttcacagagactattatattatatatctccatttcactattgtaaaaatccgacatggttcacaattttccttatgctcatttcaggcttatttttcctgattactaaggatcgaaaatacagaaaaacggcatagccgaagctacgccgttttctgtatttcccgataacatgttcctttgcttaatccagcgcaatccggaataccaccggcttatcgctttttacaccgtccaccttcacatggaagcctgcttcatctctggtacagcagcattccccgtcaaagcccagcacttccgcctttttaataatcccgtggaaattcggcttcttggatgcgtcctgttcgcccagagcagggaaggtatactccccgttttcactgcatttcatgacaatggcatacagattgccgccgttcatggtatagcggatatcgtcggaggtaaattccttcttgattccgtcggagaactggccttccaccacctgggtggggccttccccgtattttctccatacatgggagccgtaaatcgcttctccattaaccttaagccactcaccgatttccagaaggatcgcttcatcctcttcgggaatggtgccgtcggctttcggtccgatattcagcagaagatttccgttcttgctcacaatgtccaccaggtcgcagatgatgtccgaggcaggcctgtatgcgttgttttccgtatagcaccaggaattcagggcaaccgccgtatccgtctgccaataataaggcttcacatccgcgaactgtcctctttcaatatccacaacagcggtaccgaacatgaaggcgtcatgcttataattaataagtacctgctcgccccattcttccgcccggttataataataagccgccagctttttcagataaggtttgaaagaattgtgctgaatccaccagtcaaaataaagcagacggggatggtagcggtcgatgatctcacaggttcttaccagccagtcctgcaaatattcttccgtaggctccggtttgctgtaaatatcatgatgatccgcctccggcatggagggccagtaaagatcgccgcgcaccagtggttctttcacatcgctgtcaaattcttttccgtgtcccaggaaaaaccagtgttccgcccgatgggaggaagcgccgtttacgatccctcttttggcaaattcttcgcacagttcgcccagcgtatccctcttcgggccatgctcccaggcgttccagtgggagatttcactccggtacatctgaaagccgtcatgatgctcggcaaccggcaccacatattttgcccctgctttttcaaacagctccgcccacctggcggcatcgaatttttccgccttgaacatggggatgaaatccttgtagccgaagtccttatggggcccataggttttcacatgatgttcaaactccggggaatcctggatatacatgtttctcggataccattcactgccaaaggcgggaacactgtaaacgccccagtggataaaaatcccgaattttccctcccggaaccagccgggaaggggatgggcgctgagggaatcccagttatccttgtattttccttcagcaataaccttatctatctgctccagataatctttcatcttccgttcctccgtcatccgggtgttatcagcctgatccatcagtccgtcaccacacccttctgcagcatcacattggcataaagcgccgtttctccggttgcaataatggcatacgccttcttcgcttcttcataaaaagcaaaccgttcgatatggccgatggcctcttttccccgggactcatatttcttctcaatctcttcataagtatcccagataggcgtttccacatcatccccgggcataacctccataaggctgaagggcttttccacgtaggaatccagagggaatacctgaaggacagcatccaggatttccggtacgccgtgtccgtccatacggattacaatcgcatcctttcccatggattctgcggggaaattcccgtccgcaatcacaatgcggtcgctgtgtcccatttcacataataccttcagaagctgtggagataaaattttcggtactccttttaacatatcactttcctccgcctgttatttcaccgtctaagtcccacagatcttcccagtccttcgctcccggccagaggaatacctgtccttttatcagcctgcagttcttatccgccttccggatggtttccatctcttcctcggtgagaggatcctcggtaatacattttaaattactcacaaactgcggttctttaacggaaaagggaatcgggatctgtcctctctgcgccgcccatttcaggcagacgagagcgggatggatattatgcttttcagcgatctccacgatttccggcatctgagtatccgccacatcctccgccgtcctgtctctttccgggcgggaaggggagcctatcgggcagtaaccgatgggctggattccctgggaaaccgcatagtcaaataattccggctgctggaatccgggatggagctccatttccaacgctgccggcttgattttgcacagaggcaatacagccttcagcttgggcaccgtcatattggacataccgatatatctgaccagtccttcctccaccagctgttcacactgtctccagacagacatgaattcttccgctgaaaaaggtctggaatccgggttgcgggaatctccgtcacatcccggcgcatgataattgggaaaaggccagtgcacaaagtaaagatcaatataggaaagctgcagatcctgaaggctttttctgcaggattccagcacctgtccttcgccatgcatgtcattccataccttggaggtgacaaaaagctccttacgctccgcaatgccttcctccagcacacgctttaacacctcgccgatgcgatcctcattctggtacacagccgcacagtctatcaggcggtagcccgcctttatgctgccatataccgcctcagatacctgttccgggccatatttatcggaaccgaaggttcccagtcccaccgcggggatcgtctctccggtatagagagccctgcgggggattttgttctgttcaataacttccgacatttttcctcctgctgtaactgtcagctgtcctaacagttacttcctgttttcgttatctgtgaatccgattttttcagtcaaataccactgctaccttaccgcagtttcctccggccatcagcgcataggcctcccccgctttttcaatcgggaattcatcggtaatcagatcttccggatggatgccccagcgtaccagacgttccaccagttcctccattctccacagagaagttacccaggaaccgtaaatggtcttctgtccatgaatgatatcagggctgggcgtgaagctgcaggttccgccctcaccaacaaacgcgatcttgccccattcccttgtagcacggatggcaagctgtcttcccggatcactggcgctggcatcaatggatctttccacaccgtttccgtttgtcaccttcatgatgccttccatggcttcatccggtttgaacacataatctaccagtccaagctctttggcaaggccgatacgataatcattcatttccacgccgatgagcatattggctcccatggccttggcaagcataagggccgccagtcctaccggtcccagacccgtcaccagtaccgcatcatttccgcagacaccgattttttcaatcgcttcataaaccgtaccgaagccgcaggcaacctgtgccccatccttataggtcagctcgtcgggcagcgcgattaagtccttttcctccgcgaggatataaggagccattccgccgtttctctgccagccgtaagcctgacggaagcggctcttgcaggatatgtaatagcctctccggcagtcattgcagacaccgcagccggaaatatggtaaacaatgaccctgtccccttttttgaaacgtctcaggccctcgccctcttccacaattacaccgcagggctcatggcctgccaccataccggggatatagccttccggcccttttcccacatgttccctgtaaatacagcggatatcgctgccgcagatggtggtcgccttcgtctgaatcagcacctgtccgtgtccgggcttggggatctccatatccttcatttccaccgtgctgttgccgggcagcgtcgcccctctcattctcattttttccattgtcgtacccctttccttattaaaaataattttaatttcgactgatagctctattataaaagcttccgtaaaaaagtattagagaaggaattgacaactttcaataatatatgtcgcatcagcgaaggttttttcattattcagcaaacccgtcccactcttttgcccgccgcagcccattcggcttcaaatccccggaagccttgacttacgggcggggacgcgctacagtaaggataaaagcccatggcttctcaaacgcaccgcttttcagaaaggatccgaactatgcgcacaaacttcagtgatctggatatccgttttaccatcggcgacacccggttccaggccctcaatatcatatatgaaaaatttttacgcaccgttcccagccacagccacggcagcggaagctatgaaatccattatgttcccaatggctatggccgcgcccgcatcaacggacgcttttatgatatcctacccggcacgctttatgtgaccggcccccacgtggagcatgcccagactcctcatctggaggatcccatgtgtgaatactgtatctatctgaaggcggagaaaagacgccgttcccagcctgtaaccggttcggaggccgacggctccgggcagattctcgcccttctggaaaaaactcccttttggtttggtcaggatacccataatgtttcccctctggtagaggatctgttcatggaactggaaaaccgttataccggatatcagcttcaggtggaatccctcctgaggcagatcctcatccgtctggtccgtaattttgaagaaaaaaagggatccggggcaccctccggatccttaattaccacagataagactgcggtgattatagaagattattttctgtatgaataccagaacctgtccctggaggagctcgccgtcaagctggggctgggaaccaggcagacggaacggcttctgcagaagcattacggcaaaacctttctccagaaaaagacggaggcccgcatgtccgccgcagccatcctgctgacggacagcagccggagcattacctccgtagccgaagccctggggtattcctctatcgagcatttttcttccgcgtttaaaaattactatcaggtcagccccagacaataccggaaggaaggggcttaccacagctttccgctgtcgtaagcctccttttcatttgacatattctctgctcttttgatagctgtacagcagggaaaccgtcatcaggacggccagtatccccatcactatccatgcaggataataggagccggtcatatcgtaaaaaagaccgattaccggaacgcctatggcatagcctccattaaccagcatcgtagtcaccccgaaaatctcaggataatttttcgttccgaaggtgcggctggctatgatggacgggctcaccgtacttaagcatgctccgaatccgaagaaaactgccattaaaaacagtaccggcggctgctgtatgacaagaagggatagcatggaaagaaggaataccgctcctccaaaaaggatgcccgcacgaacacctaatctgtcaaaaatatatcccagaatcattttccccggtacggcaatcaacagatacagggaggaaatggacgctgccttttccatggtatagcccgcatccacgactgccgacgggatatgtatgataaccgccgatgtaaaggcgatcaaagcgatgccgaatacataagcccagaacaccggcagagaacgaagctcctttaagctggcattccattctttttccatgcgttttcctgcgttttgtctttccctttctgttttcagagtgtcatccatctcttccccgtaaggcttcaggcccttttccacaggagtccggcgtattaccagacccacggcaggaaccaggatacacagaatcagaagggccagaaaacggtaagtataacgccatccatgctccacaatcatagttcccataagcctgctcagaaccgttcctccgataccggagccggccatggcaatgctgacgataaaccctctctttttccggaaccagttagtcagcacaatattaacgggaagcatggccgcacttgtagtgaaaagcccctgaataaaagaaatgatgtaaaactgaggcagtgtggaggcaaaggacatccctgtaaataccgccgttactcccagcaggctgcctacccagaccgcatgcatatgcttttttgccataattttcccaaaaaagggggccactgccattcctaccagggaagcgattgttttcgttatggtaaaagcgctccgcgcgaagccgaactcctccgtgatgggtgtcacaaaaagactggcgcagctcaccaccggcgcataacataacgccattaccagaacactcacagcaagtatataccagccgtaaaaaagctttttctgttcattcacgattttcaccgacctcttttcccttaaatgatggtatatccgccgtcaaccagaatatgctgggatgtcacatagctggatgcatcactggaaagatacagaatggtgccgttcagctctccctgccgtcccggccgggaagcgggatttgtcttccgataggattccagatactcttcatttttgaacagcgtatttgcagtcatttccgactcaaataatcccgggcccacggaattaatggtgatgttgtccttcatgtaggttgccgccatccccattgtcaggcctcttaccgccgccttggatgcattgtaggaatgtcttgccagcgtcttggatgccatgaccgcattgacggaggccacgttgacaatttttccgtactgacggctgcgcatgccggggatcacatatttgcacatgagatacatcccttttacgtttatatccattaccttatcccagtcttccgccgaggtgtcctctaccgagcccttgatggccactcccgcattattcaggagaatatcaatttttccataatgcgtaagaacctgctccaccgcattctttacactctcctccgctgtcacatcacaagcggcggcaaaagcggttccgcccgctgccgtaatttcctccgccagctcgtccagcctttcttttcttcttgcaagcagagccacttgcgcgccatattccgcataagctcttgccgcatccgcccccaggccgctggatgctcctgcaactactgcaacctttcccttcagatcgaataagtctttcatttgtaatacctccatacctcttttaatttccgtttataaccagtgccattataccattgtgtccatctgacgagtcacagcaataacagcctttatatacaacaaagtgttgtggtagcataataataaaagacagtaaattggctcagccggacaaaggcccggaaagggaatcatcggaatggaaatcagaaaactggaatgttttttaaaagtatgtgaaaccggaagcatctccggcgcaagcgagcagctctatatcagccagcagggcatcagccggattatcagcagtctggaaaaagaactgggaacggttctttttatccgcagccgccagggagtttccctgaccgcagacggactgattctgaaaaaatatgcatcctccatctgccggagcagtaacgctttgttccgggaactggcttctccccatgaacagcagatcacactggctgttacaccgggcattctttttatgtactgggattttctgcatgaactggagaaggattccgtaaagcttacggagctttatgactaccaatgcgacaatgccgtaaaaaccggcctggctcagatgagcatcggtgtcgcacctgtgaatgaaaaactatttgattccatgcctctggcacggcatcccctgtatgtcatctgccgggaggagcatccgctggcatcaaaagctgcgcttacttttgaggatttggcagatgtccatctgattatccatggcaggcgttataagggaaaccgggaaatcatgaaaaccctgaaacagaaaaagctggacgatatccggatcagtgaaacggataatgcggtaaatatgtataaacggtgccaggatacggactgcgctgccataactgttttatttcccaactcttctttttcacggttccattgtatagctattccgctggaagaggaactgttttgggaaccatgtctgatatatccaaaagggaaaactcttacggaaaaagagacgggtgtaaagaaggaaattcttgagaatatgaggatttgaccaggacttttgcatgacggtatttatgtttcgtgtatataaggaacaatataaaatgaagtcataattcacggagggattgacagtgaaaattatcacctttgatttaggcggaacgctcatggaatatgctggaatgcctgcatcctggacggattactataaacagggttttgaagcaattaacagctactataattgtaaggtatctgaagattatatagaacaatccgtggaaatattaaaatcatttaatcccagacttcattatagagaagaagagtattcaccaaactacatattttcgaaagcattagagcattggggtaaaaatattccgatcagggattgtgtatatcaattctataccggtctgaaattgaaggccgagatatatccggatactatcccatctcttataaaattgaaaaacaacggctatcttattactacattgacagacctgccgactgcaatgcctgacgaattatttaaaagagatatctcaatattattgccctattttgatttatatgtttcttctctcagctgtggttttcgaaagcccaattgccgcggactgcagatgattgcggaatattttaatgtaccaatcactgaacttgtttttgttggagatgaggacaaggaccgagaaacggctattcatgcagattgtcaattcatccaaataaatcgtaaaaacagaactagtgaaactatctttaatctgacagaacttatagaaaaattgatagattagaacagatatattatctttaaagtatttcaaacgttcaagccgtcttttataacgaaataacaataaaatcaaagcattatactgtatcagttgttacacatacagagactttatttattcctaaatagggaatagtctgccatacagcctgtaaatagaacattattttctatgctgcgcacccgttccttttgtatatcctcactaagcgtatttccgggctcttcgcaatcgcagcccatgctgaataaggctattttgcaggccatcatgaataacgggattttagataaccagaaatcactcattagattgaccgacagataacctttgagaaaatactcaattatatcgtttgtaaaatcatttcccgcttcatcactccgccccagccataaggcaagatacaatgcatttccgatatcgaatgcataccatgaatacatacagccatcaaaatcaattaaatgaatacgttcaccatcaatcagaaaattacccggatgcagatcattatgtatcagtccatagctgtctttgtcttttggaagagtctctatttcctttagcaaatcttcggcaattttattcactgtcgggaaagtttttatattctcgctcatcatacttcgtatggaaaactcatgacgtttctccataccatccccaggagtatagtctcttgtaaaacggtgcatattgcccacagttttaccccaattataaaacacacctttattccacagcttcgggttgtttttgtcccatcgcagaccatccatcctacgaaaagcggagataaagcaggtttcaccattttcttctgccgaaaaagcaagctcacccctttcggtcttcagtggcgagggcacggttacgcctttttgagccaaatacataagccaatccatctcagccttcgtctgtccgatactgtcggcaggattttttataattcgcagcacatattgttttttatttttaacaaacgtatacatttgtttatttttctcacgtccatatgtgatgaaacggcacgatgctctgtcaaaaccataactgtcagcggccgctccgagcaaatagtctgaaatcatattttgtttctcctgagttatcatctatctggtttctgatgatgctgtaaaaatttatcatacttccatcggtatctccgggtcatttttaaaactatcactgatgccctgataaatttatttccacttaatctttccattgatatgcggaaatataaacgctcctatataatttcaggattggtaagtcatcgtagatataaaacatcaaaggacgtttcagcaatttatccggcaagtcctcatcaaattccaacacaaagcacttcgttaaatcgtcagcagtggttttgttatcaatagcaataatcagcgagtcttcatccaatatcgctttttcatccgtatccaaaaatgaaatttctaattttttcatcgttattccctctaagctcctcttcaccaaagcttttccgaaagcaaaggcagcggctccataaagcgttccagcatcccgtcttcggttatccctgcatccaaactgcctatcgtatcattccacaggcaatagattgctcccgccatccgtccggagtaaaccggcagcacctcagcctgcgtgcctgtgctgaaccggttggggtcccactgccgcagagcttccgtatccagccggtcgtaaccgcctcccggaatgatataaaggctgctgttaagggaatttataatggaaaagccggcctcatacatgtcttccggatccgcccattcggtactccagatctgcatctgcaccttatccgaagtcaccagcgttttcccgtctacccggctcagacttccccagagacgcaccgaacgtccgctctcctgaaccatggcgatcatctcattagcaaaccggcggaaatcctccccgttgccataatattcatccaggccgatatgaacgacgccttcttcgggaaaaacaggatcttctccttccaggtattccttccagatattctgtaccagctccaaagtcccttttttgctcaaatccagatgatctacattatcgggttcatcggccagagcatattccggaaacactcgtgtaatggcaaggctgtgggcgggtgtgtcaatttcgggtaccacctgtactcccttttcctctgcccagcgggtaaattccttccaatcttcctttgtcagcgcaccatcctgtgaagtaatcccttctcccttcttgttcctggtttccgattccagccggaaaccagcataagcggtgaaggcatttgctatactgtcatttttcccgctggtggaaaggatttcgttatcattcaaatggatccccagattattcattttattctcactcatatacagaactatctgtttcagggtatccatggacaccatttttctgccgatatctatggcaaaccccctcactgcatagcgcggatagtcacgaatcagaccgcatggtattccgccatctccctcttccgccttctccagcagcttcatcagcgtcccggcaccccaaatcagcccctgctgcttttccgccttcagccggatgtattctccgctgatatcacaaaaataaccttcctccttcagcccaagggaactgtccgcaaaacccagatagatatctccctttgtcagggaatcctccgccccggataccacctccgcttcatagccggtcaggctcttccaggcacctttcaaattttcagccacccccagcagctcctcttcccttccggtctgcagaaccagacgccccgtaccttccggtacaaaacagccactcttccctttccactcagaaaggcccggagtaacctccggacatgaattgaccgcttcttccctgtccgtctcttcctccccggtttcatccgccctgccctcctgtgtatccataaccggctgttcgatcttccatagccgttcatccggaggcaccgtcactgtatacgccggagaatcctcatatttcccgtcccgtgacacccgataccccaccgcaacatctttttcctccaaagtgggatacaccattccgtcctctccgataatttcctcataatccgctccgataaggctgatctcatagccctccggagccacaggcagaggaagataacggcttccgtcctccttaacctgaatttccggcacctccagacaataaaccagaggcacctcttcataaagctccatttcaagcaacgatacgttctgataatatagatactgattttcctccgcagtggaaacagccgttgtccggatccggaaaaacctgccattcaccaccttatccagtacaatactctgtgcattagcctccggttccccttcccaatccgctgcctgcacccagttttcgccatcctccgaagcttccagaacaaaaccttccacattcagcctctcccaataaagcctgacaaaagaaacacttctctcctccggaaattccaccatcagccaatgctccggctgtcccgcttcgttggcgctggaccacctgcttgccctatctctcctgttcccatccaccgcaagagaggcgccgaatttttcattttccacactgtccgccgtcaccttcacccccggcagccgggccaaattctcccgataaaatccccgggacgcatcctcttgcgtttctttaatcaaatcatccccccgcagcccaaaaaccgccagcaacagcaagactgccagcagaaccacaccccctattttaaaagttttcctcataccattttcccttttctataataatctttttctctcttttatctcttccataaactacactgccggataaaaagctgccgtacctcgaccttccgtctgtgccccctgtccgtgagggattccgtccgggaggaacggtcccggaaacagatcctttctgtaccatggagaggagaccgggcatatgggacagcctcacctgtcccatatgccgccctcgggctcatcggaatgtccggtacagcccggatctgcttccgggaccgttcctcccggacggaattcctcacggacagggccacagacggaaggtcgaggtacggcagctttttatccggcccaccccacctcagaactccactccctttcgtgcgggaatccccttctcaaacggatgccttatgcaccgcatctccgtaatataatcagcggcgtccacaataaaatccgccgcatccctgcctgtacagacaagctccagctcctccggcttttccttcagaaaatccttcagcttgtccacatccagcagtccccaattcacaggataagtcacttcatccagaataagcagctccgcttcccctgcggacgcctgtcttaccgcttcgtccagcaggcggttatgaatcttggtaagggcttccttatccgcctgtgacatagacgaaaaaaagccgaaatccttttcactgcgcaggatacggattgcaggtatatgtgcaatgctgtgcagttccccggtatcccggcctttcataaactgcaggataagcacttttttcccggctcctgccgcacgcagggcaagccccatggctgctgtcgtttttccttttccttctccggtatataaatgtatcagtcctttattcatctttttttcctcttacgctttccttttcggctgtattcctgtgaaatatacgctgataaccataaggcagaggcacacctgacatatccggccacatcggttcccggcgccgctctttttccatattgccggcggttccttttcctgtccctatctgtctgttcggacaatccgttcgggcgcaggaagcgcagataccggcgcatatttcatccttatttcctgtaagcacggcaaggtaggccacactttttttcggagacagcacataacactggttataatgaacctcttcctgaccgacattccggaatattttctccatgacctcaaaggggagctcctcgccggggaaaagcattttcttcacccataatccatatttttcccggattttcctgttcatatcctcataggcctgcagcaaaagctccgtgcagatacattccgccataaaactctcggtaagcattccccgggacgtatccttctcctgaaggcggtctggccagatgccaaggctcacaatgacctgacagcccttttcttccgtctcttcatccgcttccggaaactcctgccggaagggaccatatacatacatccccaccggccgcagccgttccataatttccccataaacctgagaaaacaacaagaagtcggcatcctcatagtgataccgactcattgctgtctttaattcatcatctgataagctgatttccagctgtattttttccatttgggttttcctgttttattcagtcaatctccttcccctgcttgcaggggattccctgcagagcgcgcatggcattcagtatggcaagcacagccacgcccacatcggcaaatacggccagccacatattggccatgcctatggccgccaatatcagcaccaggattttcactcccagggcgaagacaatattctgtttcacaatgcccagtgtctttcgggatattttcatggctgtggcaatcctggagggttcatcggtcatgatgaccacatccgccgcttcaattgccgcgtcgctccccaggcctcccatggcgattccgatatccgctcttgcgaggaccggcgcgtcattgataccgtcccctacaaataccagcttacccttaggtgatttggactgaatgagtttttccacctcatccaccttatccccgggcagaagtccggaatgcacttccgtcaggccgatttgggacgctacatattccgctgtttccctgcggtcgccggtaagcatgacaatccgcttcaccccttccgctttcagcccgctgatacaggccgccgcatcgtccttcacttcatccgctataagtatatatcccagatactggttatctctggctacatgcacaattgtaccaatctgagcggcatgagtaaagcttattttctgctgctgcattaatttttcattgccggcataaatatcggctccgtcaatcaccgcatgaacaccgtgtccggcaagctcctgcgtgctttccagcctgctcttatccagttcttttccgtattccttctgtatggaaagggaaatggggtggttggaatagctttccgcataggcggtgatttccagtaattcctctttggagatcacttcccgggactcttccatggccggctgcacttcttttaccttaaaggttccctttgtcagagtacctgttttatccatgactacaatttccgtttcggcaagggcttccaggtaattgcttccttttatcaacacacccgccttactggctccgccaagacctccgaaaaagcttaagggcacgctgataaccacagcgcacggacaggaaaccaccaggaaggtcagccctctgtaaatccagtccgaccagccgcccagaaacaggggcgggatgatggcaagcgccgcagcgcatataaccacgatcggagtatagtatctggcaaatttcgtgataaagttctctgcctccgcctttttgctgctggcattttccaccagatcaagtattttggaaacagtggattccccgaagggtttggaaacctccacctccaggactcccgtaaggttgatacagccgctgattacctcttctccgcaaagtacctctctgggtacgctttccccggtgagcgccatggtatccaggctggaattgccttttacaataacgccgtcaagaggaatcctctcaccaggcttcacaacgatgagctcgccaaccgccacttcatccggatccacttcctcttccacgccgtttctgcgtacattggcgaaatcaggccggatatccatcagttccgtaatatttttcctggaacggttcaccgcataggtctggaacagttcgcccacctgataaaaaagcataaccgtaacagcttccttataatctcctacaaaaaaggctcccacggtagcgatagtcatcaggaaattctcgtcaaacacctgcccctttccaatattcgaaaccgctctctttaccacatcacctccgattatcacataggaaaccaggaatgcggcaagcagtacgtaccagggcaggcccggcgccagattttcaagcaataccgccgccgcaaaacaagcggcaccgataagaatacgctgcattcttttctttatcttccttgtcatctcacttcatcctcctgaatatgatcaagtccctgactcaaaatagtagtaatatgtccgtctgcaagagaataaaaaattgtttttccttcccgtctgctcttcaccagatccatctgctttaatacccgcagctgatgggaaatggccgactgcgtcatgttcagtatctgcgccagatcacagacgcacatctccgaacaaagcagtacgtacaatatcttaatcctggtagtatctccgaaaatcttaaaaaaatcggccagatcatccaggtcgtcttcagccggcattctgtcatttactttttccacgatatcctcatgtacatggatatattcacagctttcggcgtgttcgtgacttctcttcatagaaagaaccctccatttctgttaccctttattattcattcaaacatatgaacaatcattcatatgtttaatgctattatatgcagactccggaaaaaatgcaagtactttttattattattttctttcagcagtcaaaaagggggacaattcggaacaattcggaagtcaatttattgttgcaatatggataataacatgttaaagtaaatgcaagcataattttctatgaatccgggcttatacgccatctactttctatattctattcagaaactctatgcttacaatccattttaaacaggcaggagctgctgaacggaaggtgattatgcccttattctatcagacggcttcctgcacacaattgcagaaaggagcagtctatggaagcaaagcattccatggaagcgaagaatttcatggaagaaaagccatccatagaaaaaacacagtctatggaagaaaaagaacttcatgtggtaaaaaaacacaaggatacggttttccgtatgctgtataatgacagggagaaactcctggaattatacaacgctcttaacggaactgtttatgaagacaccggcgatctggaaatctgtacgctggaaaacgcaatctatatgggatttaagaatgatgtatcattcttgtttgattcggaaatgtgtttatatgagcatcagtcgtcctttaacccgaatatgccgcttcgggatctcttttacattgccagacaattgcaaaagtatgtgacagggaagaccctctattccagtaagctggtgcaaatcccggttccccgtttcgtggtattttataatggaacgcaggaacagccggaaagaaggatgttaaggctgtccgatgcctttgaaaaaaaggtgtcctcccccgaactggaagtaacggtaacgatgcttaacatcaatcttgggaaaaaccgagagctgatggaaaaatgtaaaacgctcagggaatactgtatgtttgtggaatgtatccgaagatatgcggcacagatggatatagcggaagcagtagagcgtgcggtgacggaatgtatccgaaatgacatactggcggattttttatccgcgcagagagcggaggttatagcgatgtcgatatttgaatacaacgaagaagaagaaatgaaaaaaatccgtgccgatgaattcagtgtaggcagggaaaccgggaaagaggaaggcaaagcagaaggcaaagcggagtttgtactggatctgcttgagaatctgggagaaataccagacgggctgcgggagagaatcctttcggaaaccgatcttacgattctgaaaaaatggttttcagaggcagtcaaagccaaaaccatccgggaattcatggaacaaacaggcctgacaggaatcacctgaaggttcactgtctagcgccttttcccaaaacaattttacatgggtttccacccgtacttctccagtatttgcctgggaaattccacgcgaactgtcatctggggatctacaatttgacatatacacatatccgctgccagggacatcagcattcctgctttcaattcgtctattccggcggtttcccggatatattcttccatcagcaatacggctttctttcccgcctcatccgtcgtgtccgccgactggattgtcatcaccttatccactgtcacaagaaacggggccggcatacggcagtccttcagcacactcacccgcacagtcacttcacccgccgtctccaacccgcagataaacacctcgccatcccccatcagagcatggagatctcccatggacagcagcgcacccggcacggcgaccggcagatacaggacggagccttcaccgattttacggcaatccatgtttcctccatgaccgccaggcgtctccgtgccgattccctcccctacgggagccgtacctataaccccgatcatgggacagcagtccagcgtcagtttctcgtcaaaacggattttattatcaatgatttcaaagatcactgccttcggatccggaaacctgcctgcaaaagctccataagaaaaagaggagcacatgactccccagcttcgaagctctattttaaggatttccaccttcaggatatcccccggccgggcgccatggatatacaaagggcctgtggccggatttcccagcgcatccctgcggtctcccaggggcctttccccacaggtcacgctgtcatcgtagcagtccctggtctggaataccacagtttccccgctatcacacacagccgcgggggcgactgacttatcgagactgtcctgaacatattctctgctgatatataacatccgtttacgattcctctccgcttttctccggcatttccgccgcttctgactcttcctttttttccgtttccgcctcttccccggcaaggccggttcccttcaggatcccccagatataaggggcaccgaacatactcagctttttagggccgcggataggctctcctgcctctcttgcttcccggattttcttatatgcccggagaaccgtagcctgggtaatggacttttccttcctgtcacaaaagagctcccgccccttcactctgtatgtaaaaggcagcttcttgctggtataaaacgtactgcctgcattaagctctaccacattccacagaagcgttcccagttcttcctccgattcacatttcctgaccgcttccaccgccgcctcacattcctttatgttcatctcatccatatataaacctgcttctttccagcgtgcgcctcagaaaggctgcctgctatgccaacggttccttatcctgaaaaagcaaggggagaaagtcccggatacactgacgccatacgttccagtcatggcctccctcatattctttgcggatacagggaattttattttcttcacagaatgtgtcatcctcagcgaagcgatcccaaaattcatcctgcctgcccatggcgcggaaaaacaggtgcagccccttttggaagttttcgtccttcatgatttccaggaaactgttatcctggttttcccccatgcagtcgtgcatgaagccgctgaaaagcccttcccagccaaacagctccccataccggcagaccgtcatgctggtctgcatggaacccatggaaagccccgccatagcccggaaatctctgtccgcctttacccggtatttcttttcgataaaaggaataatatcctccaccagctcctccgggaacagattatgccttaagatagtctcaccctctgccgtttcatccatcaccatgccgtttgccatgacaatgagcatagggacagcttttccttgggcaagcaggttatccataatatgatttacctttccctgccatacccagccccgttcattctctccaaacccatgctgaagataaaggaccggataggaaccacggttctcctcgtagcccggcggcacataaacgatacaggtctctgtccttcctgtcacagaagaattgtaatactcatgacggatatccccgtgaggtacatccttcatctggaaaaagtcgggcaccggcccgatttcaatatagttaaccggtctggaaaacccatagccgatagggagaaaaggattgagcaccaggcagttatccacgtacagattcgtgtaatagaagccgggttccagcgggagggtaaccgtccacacatctttttccgtctcaagaaaaggatacatcatatcgcctatctgcagctgcacattcatggcattgggataacgcagacgcacataaggccttccctccgctctgtacatcagtccctcctgggaattgtggggcaccggcttttcatttgtctccacaagcaccggcctgctgtatgcacaggactgttccaccacgcccgggttgtccatccattccttaccggcatcgatttgttcccttacctctatcgtaaggttttccgtcactgcctccgcatcccgcagcgtcttcagcacaccgtccagattgctgcccagacgtttccggcttttatccaggccttccactataatatgtattctgccggatgcctccgacagcatggcgtatatattgtccagattttctcctctggattccggaagattcagctttccctgcagataacggtacatttcctccctggaccgtattcccgcaaagttcagtttaatcatacctttctccttttctttctcattgtccttcatcctttgtttcttccttcctgtatgcagctgccgatcccggttccataaaggaggcagctatccgtgcgggcagacgtttcttcgcggactgcgttcaatcccctgatattgccctgcgaatcttgcttttaatcctctgcagcgcattatccgtacttttgccgtccttgcccagaacccttgcaatctgattatagctcattccggtaatataaagatccagcacctgcttttcaaaggtgctcaattccttatcaatcgcctgctccagcacctccacattttcccgatcgataaaaagctcctcagggctcatctccaaagcggccggtatggcattcatgagattgttttcttcattaccgtccccgtcctggcttccgtctcccccataaagggagatataggtattcaggggcatgtgctttttccgggaagatgcctgcaccgcggtatacatctgtctggatacgcacagatccgcaaaggtgctgaagctggcgtctctgccgctgtcataatcccggatggccttgaacagccctatcatcccctcctggatcagatcgttgctgtccccgcccagaagatacatggatttggcttttgtcttgaccatccctttatatttttccatgatgtaatcagtgatgtcattctcgccgtcacgaagaagcacaatcaattcttcatcactgtattccccgtaggaatctttcattgggaaatcattcctttctgatatttccggttcaatcaggccccgtgtctccggcccgcagtcttactgttccgtcttttgctgcctcgactgcagaatacggattaaatccgccgccacatgctctcccaggatctgatagccatccgcattgggatggactccgtccggcataaaatgaagcacattatccttgtcatgtccgtccaggatgttggaattatacagatcaattacttccattccgtgttcctgcgccagctggctgatcacatccgcaaacttatcctgggaaatcaggtagggatgctgtgttttcagataatcctgaagactgttgggcagaggggtcatgaaaatcacctccgcatggggataattttccttaagcccgtccatcagttcatccagatctccccagaaggtccgtttcttcctctctgcggagtttccgaactccacaaggctggcacagaattcgtcattcgttcctcccatcacaaggatgatatcggtgtctttgggaatattttcgtaccgatccacaaaggcatccgcccagtacctgcctatggaagaaccgccgatacccaggttatacacctgtctggcatccagagcttcccccagcacgtggggatatgcaagatcctgataattttctatactgtccagattgaccgcctgggtgatgctgtctcccagacaggttattttaatatcggtaaaatcaatgttattttccgagatggtccttttatcctgttcgttcaccagcagggtttccttatgggagcttcgcacagcctgacgctgtgccagggtataacgcttctttccgaaaggattttccagcctggattcatttttccctctccggtaaacgatatcgctgccggaaaccgtattgcctgaaatatcattatccgaaacaccattgccggacacattatttccggatatgtcatttccggacacgtcattcccggatacactgtttccggacacttcgccttcttcttcctcttcgtcggcagtatccttttcggcttcaactttttccgacgtatcgtttcccgagaccgaattatccgacacggaattgccggatatcgaattaccggataccgaatttcccgaaaccgaatttccggatacgctgtttccggacacatcatccccgcagggcctcagcagctcccttgccggtattttgttgccggacacatcctgtccttccgtttcctccccggaaccgtcttcatccgggatcccgtcaccggatacctgattgccgctcacgttttcccctgcggaattctgagatacgccggaatccttttcccctgcttcttctcccgtatcttcttcggtttgtccgcccttctcttctgctgcagccgcctgctccccgctctccgccgtgccgtcctgcgcaagcgtctccacattctgtacaagaacgctgtccgcctgcaccgccgggacatcggaaggctcttctttcggagtacaggctgccgcaaatgataacaggaatactgccagaagactgctccccgttattttaaggaaaccaaactttttcattataacagacgctgccttacgatttcatatgccagaacacctgctgcgacagaagcgttcagggaatcgatatttcctttcataggaatagaagcgataaaatcgcagttttccttcaccaggcggcccacgccctccccttcatttccgataaccagtccgatagagcctgtgaggttcagatcatacatcctcgtcccgtccatatccgcacagacaaaccacatccctttctttttcagttcctccatggttttaaccaggttggtgaccttggcaaccggcgtataattcagtgcccccgcagaagtacgcgccacagcagccgtaagccctaccgcccggtttttgggaatgatcacaccatgggcacccgccaggttggcggtacggataatggctcccaggttatggggatcttcaatattatccagcaaaatcagaaaaggaggctcctgtttttcctccgccagcttcagtatatcctccacctgggcatactcataagcggctgcataggcaatcactccctgatgctttccggtttccgacatctgatccaggcgttccctggaaacatattttatgaggcagtccgtctttttggcctccctcttaatggtcataatcgggccgtcctgacagttatccagaataaaaaccctgtcgatagtcttgccggaacggaatgcttcgattaccgcattacgcccttcaatagtaagttcttcgtatctcataacagctccttcttataaatgaatatccagttcattcagggatatcttaatcagctccataagcctgtccatgcggtcatccaggtaaagataaccatacagggcttccagtgcggttgcttttctgtaatcccccaccgtggcattcttggccgtggtataggatttggcattccttccccttcggaaaaccgcctgctcttccggggtgaggaaactctggatagcatcgcccataagcgcctgtgtctgggcctttaccagacggcttttttccttatgaagcctgtttggggaagcattgtggcattccaccactacggtccttataatcagatcataaatgcagtctcccacaaaggcaagagtcaggggggagtaggtccgcagatccacttcccccagcccgaattctctttttatctgcgccagcaggcttatgctctcttccatttcactccttcacgggtgtcctccaggataatgcctttggcaagcagctcatccctgatttcatccgccctggcaaaattctttgcttttctggcaacctggcgttcttcgattaaggcttccaccgaactgtccagcatttcttcctttttctccacgatcaggccgcagacatcggaaagctccttgatttcattcagaagctccctgatataggcggcggaattatcggcagaggtattggtgttgatgaattttaccagttcaaaaattgcggcaatagcatccgcggtattcaaatcatcatccatggcttcgtcgaatttggcggcaaagcctgccgcttcctccagaagctttatctcttcctgggatttttccctatcttccgctttttccagaaggaaattcaggttcgttaccgcagtacggattctgttcaggccgttctttgccgcttccatcagttcatcgctgaagttaaggggacttctgtaatgggcggacagcatgaagaaacgcactacctgaggatcgtatttggccacgatgtcacgcacggtgaaaaagtttccggccgacttgctcattttcttattatcaatattcaggaacgcattatgcatccagtatctggcgaaaggcttgccgttagccgcttccgactgggcaatctcattttcatgatgagggaataccagatcctctccgcccgcatggatgtcaatttcatcacccagatattttttgctcatgacggagcattcaatatgccagccgggacggccgttgcaccagggggattcccaatagggctctccgtcttttttaggcttccagaggacgaaatccaggggatcttccttctgatcttcaccggaaaccagcagagagcgcttgccgccttccagatcatccaggtttttatgggaaagcttgccgtattccttaaagcttctcacacggaaatacacggttccgtcggcggccgcataagcatggccgtcttctatcagcttcccgatcatttccagcattccgcagatttcctgggtagcctggggatgagtggtcgcaggcttcacattgagggattccatatccttcctgcattccgctatataacgttcggaaatgactgtggaatccacaccttcttctatggcctttttaataattttatcatccacatcggtaaagttgctcacataatttactttatagcctttatgctcaaaataacggcgcaccgtatcaaatacaatcatgggacgggcattgcctatatggattaaattataaacggtaggcccgcagacatacatctttacctcgccaggcgtaatgggtacaaattcttcctttttctttgacagggtattgtagattttcatcttcttatggttctcctttttctctattttcgtgaagatactccggttctttttattattttcattcttccacctgcgccggggcaggacaggaaacgtctcctgcgccctttttgcagcacttcagcgtttcatggcaccgttccttctgcctgcattcctggcggaagcagcattcgccgtcttcacattctttttcttctgttcttttaaggtaacgcacttccgcttccaggtcaagcagtctgttgattaattcgctgtttgcatgctgtaaattggaaatatcctcttttaccggatccggtaaattcacctgatccatggtatcacggggtatcggctggtttccccttttcaccacccggccgggaacacccaccaccgtggaattgggggggacttcttcaaggacaacgctgcccgctccgattttcgaattttcccctatggtaaaggaaccaagcaccttcgcgcccgcgcttatcatgacattatcccccacggtaggatggcgctttccgtgctccttacccgttccgcccagggtaacgccctggtaaagagttacgttatcccctattatggctgtttctcctatgataactccattcccgtgatcaatgaaaaacccttttccgatctgtgctcccggatgtatttcgattcccgttttgcgcacgccccgctgggagatccacctggccaggaaaaaatgaccggatctatacagtctgtgcgcgaggcggtaatgaagcatcgccttaaaactgggatagagaaatacctccatggaagtatggatggccggatcccgttccctgataatccggatttcttcttttatatttccgattatgcccattttgcttccttctttcctataggattgacagaagacaccaacctccttgttttcacatattctctcttgcttcttacgtaaaaagaaaaaacgcgccttcttccatcctctgctaagagacggttaaagccgcggttccactctgcttcaggccataaaaaataacagcctgcacttatatcgcgtaacgtgcgtaaacgtacccggttaaagggaatttcttcctttcaccggatcagctcccggaggcactttcagctgtccttgccgggaatgcttgcagccggtgacactccctctctgcggcagaatacatacttactctttccgttcatcgcctttttcctatcatccgatcgatgtctatgtatacagaatatgcaataatagcttttttgtcaacttttttcagctatatgggtgtagataaaaaacataggcgccgctgtccgtgtccctgccgctctccggcgctgcccggttccgtctcctttctcctgccgctctgcaaggattcctgtaaggggcgtataagcacgccggtccttaggctgcgtattttgcagccttagtaccgctgcgtgattatccgagcgataagcaaaaacgactaaagtcgttcccctgcaaggaaccttgcagagcggcaggagaaaggagacggaaccgggcagcgccggagagcggcagggacacggacggcggcgcctatgttttttatctacaccccagctatatgatttcattgacacatatatcgctaagcgtctgtacctgttccaggctgtgcagcagccctaccatttcccaaaggtagcctccgttgaaggtaaagcatttctctgccggttccctgccgaaaaggaaggcacagaaacgatccgccgaggtttccgcgtacagctttcctttcacttcttcagatcctatttttttgacaacgctttcttccggcccggatttccagtaaaagtagccgttgttttcttcgatcaggttgtccgtgtacttcatgaagacttctattttctgtctgctgcggatcagggaaagcatggacggcagatgcataattcttcccatgaccgcaggcctgcgttcgggagccggttcgatcagaagctcctcatattcgggaagcaccaggacttcctgtatttcttcattcttatccggcccgtacaggaagtaacccacaacattatcgtcattcaaaaggaggaatatatctccctgtctggcatgcatttcctgtaaagccatccggtaatagtccccggaacgttccgcaaacagctggcacctgtgttccagccaggacgcggcaaaatcagccacatgggaaatatccgcctcttccatgggccggatttgcagcatgtcggagcccgtatgcagcttttcttcccgtacatcctccgccgcctgcagaatcttgcgttcatatcggatcgatatggtctctcttgtttctccctttaaaaggggcagtaccttcaggataaattccggctgaagtgtccactttggtttattaaagacataaataaactgaaaaagttcatattctgctgcagcatccggaagcagatacataaaagggtgtttctgctcatactgctgcagacaggcctctctcagaagcctgcccataaaaccgctgtgtctctgcgtttcaccgcttaccgcacctgccgcataatcggcttctatcacctggctggaatttcccgttttcatccgcagcctgccgccagtcagccagagcatcgcctgcgctttcccgtcctcttccatgacaagcgcactgcttttctccactctgttttcaaaggaggaatccataaaaagccggatatcatcgcaaaagccttcttcccacaggggccgaatactgcggcagactctgccttctattttttttatctgttggttctgtatatccattttattatccagcctttattgtattccgtttttcggacagcctccgcagcccgcacagcctgcattgacatcagatgaatataatccgtagggtgtatttaaaaggcagactgcctgagaagaaattccttctcccgtaccggtgaagcccagcccttcttccgtagttgcctttacatttacctgggatacctctatctgaagaacccgggcaatattttccctcatcgtgtcaatataggggcgcattttaggcgcctgtgcaataatagtcgcatcaatgttttcaataaggaagctgttgtcctccagcagctgccctaccttatccaaaagctccatgctgctgattcctttataagcaggatccgaatccggaaaatgctttccgatatctccaagagccgccgctccgagaagcgcgtccattatggcatggagaagcacgtccgcgtccgaatggccaagaagacctttctcataagggatgtcaactccgccgattatcagctttcttccctctgtaagacggtgcacatcatatcccattcctattctcatgtgttactctccttgcatccttccattttcctcccgcgcaaaagcaccgggcttctgcatgggaaggatatatatgttgaaagtataccacaattcgggaacaaataacaggcaaaccactcctcattttttctcaataatttcttcaatggtatccgcagccttcagggctccgccggcccttttgaggcccgcgcctatttttccggcgttttcactgcaggattggttttccaggagatatgtaactgttcttttcaggactgcggggcgcatgcttttcagaaaaattcctgcgcccagttcccgcacgcggcgtgccacagcaccttcttcgggctgttggggaaacagcacaagagggactccaaaataaaggctttcactcacactgttcataccgcagtgggttataaaaacactggcttcctgcagaacctgaagctgatccaccctgggggatatggtgaaattggacgggatgtctcccagggaggggatatccgtacggcttcccaccgccataatcacatccatgttttcccccttcagggcctccatgcaattacggtagaagctgtcttttttattcagcacggttcccagagaaacgtaaatcaggggacgtcttctttcggcggctgccgagacaggaaccgcaagggacggcccggtaaagcggtaacgggaagaaaaggtatccgccatgggctggaattccggggaggtatatacgatggtatccgtatcattgtcattctgcagcagttcataaaatttatccgcctgatagccatgctgctgcagttcctccatcctcgcattgatttcggacatccccgccatcatgcggaagatttctccgggcttctgcttcatcagctttgcggtgtacctgttgaatgcaaaggtggttgtagaacacacataagggattcccagccttttggcatagagctttccccaaatgcagatggaatcggacacgatgcagtcgggcttccattctccgaattctttcagtattctctcttccatggccagggtgacatggacggtcatggaaatcagagacgccaaatctctgcccactttcttatcaatatccgcgggggcgggaggcatgtattcatcacagcagatgcaggccgcaccagtgtcctctatccgatcccggaattcccggaaggaataataatgaacttcatgcccccttttcactaattcacgtaccacctccagtgtgggattggtgtggccatatgcgggaatgttaaaaaatgcgattctgctcattatgtcctccttttgttctacttttatttatttgttttatatatattacttttcttacttttataaccaaattatactctttacgttatccagtgtcaacataaaagactgccgtatgagaaattggttccaattctcagacggcagtccctatttcatatcctggcatcattcttcttccggttcctttttactgaaaacatcatcaaacagctgaaccgtgctgttaaagggcagaatgcctattccctgcgcttcatccgcgagcaggagaagcatgtcgccgggttcgattccgaacatatccctgacttccttcggcacaacaatctggcctttgggccccacttttatggacgccacaaattttccctccggcggttttaactttgccatatatctttccttccttctgtcagcttttcaatccacagtatcacttgtaagaaaaatcttaccaccgtttctgtcagccgtcaactctgttccttatatccggttatcctgccggcttgttttgccagttttcaggccgaaaagactgttcagaacaggaatcctgccaaagcccatacccaaaagaagcgcggctgaaagggagaacaggaatacaaggatataattccacaaataaggaagggtgaatctgtcggtcagaaaccaggcggcataaatcatgggaacataatgaaaatagtaaatcccaaagctgaggcggctcatataggaggtaaaccggctgcggaaattaaaccagcgtccggtggctcccagaagcccaaggagcatgagccaggtatacagcatcaccaccggattattcactgtcatctgataagggattccccaggaaaacaccgtctgggccgctcctgctgccagtcccgtccccagcaggggaaggcagtatttctgaagctgccgtattattttttcatggtaaaaaacataatatcccataagaaagagaagcagatacaaacccacgcggaaggtataggcgatatacaggatttgggcggaggcaagcaccgggaaatacagaagcagcagtatgggcagcgtacatttttctcccagcgcggacagccgtccttttttgtccgctttcctgatccccgccaaacatgcggataaaacgaacagctgcagaaggaaccaggacggccccattccctgaactgccctgatacagaacaccacccattccggcagggacgcaaacgcttcggggatcccgtttacccggatggaaagcccggaatccaggggcccgatgagcactatataggaaaggaaaggcaaaagcagcctgcgcgccctgtcccgcacaaaggccctgccgttcctcttttccagagaaatgcgggcacagatcccactgaccacaaacagcagacacataaaccagggatatatcagatatccaatggtatccagcgccggaattcccggcgcatttatactcatcaccgccccacagcttgaaaaaatgctgaccacatgaaatacaagcaccaatataatcacggtccatcggatattatccagataattttttctcatcaatccatctcctgtccagttatgcatccggcttatttactatacattttgtcacacatgtgtcataatcaaaacatacaggatccttccgacaaaagcaatacgcggaaggatagtgcaacaaaacgagaaaatgtgtgacaggaggatttcatcatgaataaaggccagtctcatcccgcttccgctttatcgaaaaatttactctccaaaggactgctttctctgctggaggaaaagcccttccgtgatattaccgtaaaagagctgtgcgtccgttccgatatagcaaggcgcactttttaccggcatttccatacggtggaggatgtgatggattatgtgctttcacatattatcacccggttccgggaacagatgctgcttacacaaaaagagacgtacccttccatactcgcttcctacttcgctttctggaaaaattacgcctctcttcttgaacttttaaacaaaaacaatatcacatatcttctgttcggaagatatctggaatgcctctcatcccttccctggctttttcctagtgaggacagccttaccgaagacagggattcctttgcatgccgccttgcctatcattccggcggcctctggagcgtcctgacctattggagcatgaacggatgccggataccggaagatacacttgcccaaattctatgttcccaaatgcctggtgctccatccggccggaaccagaactgacagtactgtttccggccggatggagcactggcacccgttaaaacgaatctgccgtaaaccagaacaccggaagcgggaaccacccggcaggcgccggaacatccatgtagcggtcatacccggaaagcagaagctgctgggcctgctgtttatccagagtgatggctcccggcagggcctttctttccacacggaccccgttttccgtcacacgcgccgtcacaggctgtccgtccaggcaggcggaaaactcacccggcatgaggccaagagtcctttgcttcagagtcaggtaggcttccagtacgtttgcaaaatcaaaaatctggtacatgccgctcgggcattcggaatagctctctgcaaaccttccgatgcacttatttaaaatgcagtcataggcggaagcaaatatcatgatttcttccgtaccggcatattccatgtaagccttcacggccttttccatatcttccggctgttccaccgccatctcacggatctccttaccctcattacaggtcagaaggtatcccgcaaggactccgtcctttttcattccaacagccttttcattcgccgtcgccgcaatggctaaaacgttctccggctctcttgttacccaggagggacgtttctcattctgccggcacataaattccgccgcgccttccgcctctgaaagagggacaaaagagattccccgggtatccgtctgcttcagcgcatggcggatgttatcactgcttaccgtataccgtatctgtatgccgccccgtgtaaaaccaaaatattcatatctctgccgctgcccgtccagcactgcaatgtcacaggtctcctgcatttctttcagccagtcctgcatgagtctcttcatgtggccttccccccgcgctttgggatgcacggaaacggtccccacaaaacccgcccgtagaggatgtcccgctaccatgagtttttccggcaaaaccgcgatctgagcccgcagcttaccgttttcttctgccgctacccgatgaataaaggcggaatccacaccttccccatataccttgggtatcagcgtttcaaaatcatgaggacaatgagccgtgctgaaaacataatttgccagttctatacaggcatctttttcttccggcctcgctattctgtattcactcattctttttaatacctctttcccctgtttttcatttgtagcgccagtttaccccatatacggacggctgtcaatcacttcaccaccagatcctctgactctccaaacgcccgtccctcgtgcacccagttttctgcttcctgctccattattttatccatcatctcctgaatctccatgctggcgttaaatccaatccctttcacagcctgatcgtatctggaaaaggttatcattgccttttgtccgtttaccccgatcacatttatagtgatttcaggatcattgcttccgtagccctgactgttataaatacattcctttacctcgccgttcaccagatttttcttttccgcaaaagcttttgccagcttcatatattcggaagggttcttttccagcccgctgtccagtcccaaatccacggttacattgagcgtcctgccgaaagaggcgttgaaggcttccccggtgactgcgtcaatgagaaaagaatagctcgtatcccccggcgtcctgctcttaccgaacctcacatcaccgctccagaacgctctgggaaaggtagcagttccgggatcataacccatataaatggtagcgccgtccagcttcacaccaaacatcttccaaagcagctgcgcccccatttccgccgctttttcctgtgacaaatccttttctgaaggctttttgtccttgtaatagtccagaggatcctccacaaccgtataggccgccttctgatacccttccggtaccggactcgtttccggagctgccgggagggtataagcagtcggaatcatttccgcccctttcatatccaccgcggcagccgcttccgccagaccgctgaacatagccgtacagccaatcaccagcgcaaaagctccgcatattgcaagaccagtttttcctttgttttttctcattaatccttacctgcctttctttttgataaggctactataagccggaattataaggaagttatcaccgacttattaccgagttgtaaaaagaaaataacttttaacacactaacccgcttcaaaaggaaaaacaatccgtacggttgtgcctttctgcggtatggaatccagctccatgaccgcctgatgaatgtccgcgatctgttcgcacagagacagtcccagccctgctcctccttctttccggctgcgggccttatccacccggtaaaaggcttccctcacccgcccgagctcctctggcgggatccctcttccgttatccgaaacactgagaaccgctttttccccgtcccggtaagcttttacctgtacacacccgccgctttcacaggcctttattccattgtcaatcaaattgataagaaggctttccagcaattccggatttcccttcagcacatccagttctgcctgaaaggtcacagttattccccttttttccgccttggcccgtaccgtatattcaaccgtttccataagccgctccacaggaaccggctcccacgctatatcttctccccgcagagcggccagctccagcagctgccgggataaattggacagccgccggcattccgacatgatatagccggcgcaggccaccttatcctcctccgtcacagccgccttctggagatattccccatagccgtaaatagccgtgaggggcgtacgcaattcatgggcaaaattatccacaagccgctgcttctcctcagcggcctcctgaagagccgctatctgcctttgaatggtggacgccatttcattaaagcttttggccattgccgccacctcatcctttcccttttccggcagcctcccctgcaggtctccggaagctatactgcgggaggttgcggcaatctgctgcaaaggcgcgaacagccggttcagcagggtgagaaggcacagggacaaaagaagggaacagccgcttcccccgagaaaaagcgtgtttttcagtttcctccaattctcatacatctgtctcagatcataccggtacaccagaatatagtcatcccacggctgcgggaatttcccctccacataaagaaacagcccgtctgtccggatcctgcgcattccctcttcggctgccgctgttttttccatgtcaaaattatcccgatcatccacatcggaatataacagctgctccccgcgatacaaaaacagcgccctccgcttatccttccggtaccgggtatatggctccataagcttcgccgcatcatatccgtccccgccctccgcctgcatatcacgcattaccgaggaaaggatcatataatgttctgacaaagccatctccttctgtacctccagtttttctttccagagcatgacggaaagcaaaagaaccgccccgttgaaaaaaagaaggaacataaactgcgtggtaaaaaaggtttttttcttcatttcataatctccagccggtatcccagcttatagacggttttgatacattcctccagaccaagctttttgcgcagcttctggatatgtacatctaccgtgcgggtatccccttcataatcatatccccataccagctccagaagccgttccctggaaagggcgatatttcggttttttaccagtgtttccaacagctcatattctctgggagtacagtctgcagcctgtccgtccttttctattaccctgctttcaaaatcaatccggacgccgtaaaaggtaaaatccttccctcccttatgtgtccttctcagaaccgcttccaccctggccagcagctccagcatctcgaagggcttgaccatgtaatcatccgcccccatgcgaagtcccttcacccgatcggtaagccccccttttgccgtcagaaaaatagtcgggatctcccccgcctcccggtacacctcaaagccatccaggccgggaagcataatatccagaagcatcagatcgaaggcctgttcctccagcacctccaccgccgctttcccgtcatacaccgatctgcaccggtgtccgaccagctccagatttctccggagcagctcatttattgctgtctcatcttctacaatcagaatctctgccatagctccccctcatttttccttttcctgttcattttattatggacttgttatgaagttgtaaaaatcccggaagcactttttctcttttcattttcaattccgtaccgttcacaaaaaggctatggaaccttttcctgcggtttccatagccttattcctgtgccggttttcttagccttttttgttctccaaatccctgactcggcggagaagctcttcatattgttgtttttgttctttgatcaacagctcctggctgctgatagtctgtttctggtcattcagtacttccgtctgcgtatgaatcgtttccttctgttcattaattatttcctgcatctcatcaatcatatactgcaccgtattccgatcaagttcctgcagttcctttgaatacattcccatcaccttctccatattgagacagatttcatagatatcctcgtagatttcacggaagtccggatagctttcaatcagttcaatgatgcgctccggttcctctgatccaaaaaacatcagccaggcatccagctcgttatccacacttttattgtccatgttttttcggaatatgtcaagcgctatgaagataaaattctgcagcagattgagttccagccccgtatcaaatccccagaaggatttatggatatatgcattttccagcctttttatttctgccgggcttttttcaaacaagacgatggtataaacattttttatgttcttataactgaatttccgattccggccctgtatcttctccctcgcccttttgtattgtctcagcagcagatccgccgaatagcatgcgctgcgttctccgggaaaagcatagcctattttctggatctcaatatccgcaagtcctccgtcttcaaattccactacaatatctgtaacaagcagagaaccttctgccgcaatcctcgtactgtcattgggaattacctgcttaatagtcactctttttcccaaaagaagtgacaggaaccgattcagcctgccaggtgaatattcaggattcatgatttccttaaaaaaggaatcatataatatttttactcccttaactcctgtacagaaatcaaggaattcttcctgccgttcctgctcccagctgtcaaaaagcgtacttaaagccatagaactgccaatctctttcagcacctcctttctttccctgatcagcgggaaataatctttgagcctgtttgccataagcaatgccctcctttatttagttttctgtcatcacctggtaattgcttcgaaaaggaagcacaagaaagtgaaagacggcccttgggcctgaacaatatggcagcttagataccgccatgtgacgaaataagaataacatattgcgggaatttacgcaactgtattttcatccaggctgcggattcaatagctgttccacagcctgaatggaatatatttttattgattatccgcatgaagagtaaaagtgatgaaatccagggcaccttctccatcgtaacggaaatatagatcatgaggaccattggatacggaaaccatacctgtgatatcctgccatgtgtccgcagctatgtcaacgttcagggctccggccggtttggtgagatcctccgtaaagacggtgatgattcctttcgcttttcctctgagcttcagggttattttctgcaggttataaaaagagaagcttttgtagcctgacattgttccgtcttttatgttggcaacgtactgaaccggcagggtgtctccgctcatttctttttctgcagccggttccttgtcggggacatcctgggtcaggtaggggaaatgaagctgcatttccttctgtccggagaatacggcgccgtctttgcctgtcagcctgcagcagatacaggcgggatatgtgccttttccttccagagggccgtcgttcaggccgcaggaggttacgggtacctgccggatacttccgtcatcggctatctctattttttccgcacagccctgtctgctgaactgggtgcggttactctgtctgtgataaaaaacataccactgtccgtttatatattccatgccgccgtgggtatttcccaggcagttcagcgcttctgcggcggttcttccgttcaggcccacatccccgatatcgatcagggttccgccgtacttgtaatccctgtcaggcttatcgctgacagcataacacagctcgtggctgagaacggaggaatatacaaaataataggtgtttcctattttgcggatagagcttgcctcaaaaaattcatgtccctcaaaaccagtcccttcactgtccgcaatggatggcagcaaaagcctgggttctgttttcagggtaagcatatccggttccagcgtcattacctgggagccctgttttccgccgatatgttctttatgcataggggcgttgccggaatacaggtagatttctccgtcatcatcaatgaaaatccccggatcaaactggctcaggtcatcctctcccttgcccaggactgttccgtctttatggcgtaccaggcctaaatattcatagcttccggcaggagtgtcgcatacagcaactccgatctcaggcagaaaatccagacaataataaaggtaatatcttccatccggcccttttaccacatccggcgcccacagggcatggatacccggaggattcaggccatttccgaatctggattttacatcataaattctggttatgctgttatcctccgaaggattctgattcctgggatcctggtctttccgaaaaatcaccccttcatatttccattctgtcaaatcctttacgtccgcagaataacaaatgtaatcattcaggcagaacatttctccgtcaaaccggtcatggcttccgtatatatagactctgtccccgaatacatgcggttccccgtccggaacatactcataggtcggtaaatagggattatatacctgctttttttcagctgcttccttcatcttcttcctcctgcactttattttctgtcatgaaattgtagcttttttattatatcacaataacttccctatacatatcccttatctgaccagtcatgttcctttatccgctgatattcttccatggaaattgtcaggatcgtgccgtgcttaaagccgtaggggaaatcaaaagaggcatccgatctgacaaaccggccatctgcaagactatcggcaacaaaaggcacgtagccctgtcctgctccgggtaccccatagtaatccaaaaacaggcaccatctgccatcctccagctttacggcagtgggagcttcatacagcccgctttccacagcctccatgctccggtcaaaggcttccactcgttcgtaaggccctgccgcctgttctgatttcaggaggatgattttttcaggatttccctcgctctttacaaacatataatacaggccgttttcttcatagacggcggaatcgataataccgctgtcctctttcctgtacaaaagttcaggcttgctgaattcgtgaaaatcttttgtcctgcagaagtaaattccttttctgccataatcattgcagctgtgtgaggaagaccagtgaaggaggtaatctttattttccctgtcgtaaatgatatccggcgcccacaggcagccaaagttctcatcgccaatcttcacaagccgctgttcggtccagtctgtcaggttgtccgattcccatacggaaaaacatttgcttccgtttcggccgatttcctcccaggagccatggtattggtttctcatgccgtaggaaaggctgagatccgttgcaaatatatagaatctgccgttctcctcacacctggtaattgtgaaatccctgactcccttgtctccgtaataggtccagaggaccggatttcctccattgacctcctcccagtggaagccgtccctgctcagtccgaaatatacctgttctccgtcaggggtggtcttttctttaaaatgtacgaataaatatgcctgcattttttcctccttcgatgtgttgggttttcttttcattataagtttttctggggagaattggtatgtgaaattttttaattttagggtaatatttatatctccttcagtctgaaaaccgtcagagaaaatttggggaattcatacataaagctatcgttttccttgtaaaacaccgcttcctgcggtgccactctctccggctctgcaaagtcattttccgccgccaaatctgcctgcatggtataaacggttccctgaagcctgctgccgcacatacccttcatgataatatgtgcgcttacaccttgctcctgcagatttaccaccttaaggataacggtttgatccgcttcatcacggctcgctccataatatagaggctctgtcatcaccggtttgtcctctgttccagcgcaaagcctgccgtctacccatacgcgcaccgtacgcccggacacctgcagtttcagtaaatattcctgtcctttgctgacccggataaggctctgggtcaaatcagaacagcaccctcttatccttctgctgagcaaaagatcataattctgccagcctcccaccgtccagctgttattattatcttcatcctgccatccaaaaaaaatctgaaagccatccagttcttctgccctgcagctgatgatatagtccttccattccgtatctgcaagccagacagacgcctcctcctttttcagatgatagtctccgaagcttaccttttctcctgtcttactgttctccagcacaacgtccctgaaaatgacctctgaatgatacccctgcagcctgattcccccacatataggttcttccttaattccgggtgcttccagtccttccgtatatatctccagccttctgcttccctgatgattcataaaaagcttctggacataataatcaggacttccgtatatccggtggttatcaaaccacagcatatccggcttccagttcacataatcgacatttgcaagcataggtgcataacaggctaatcccacagcctttgcattccgttccagtcccagcataaagctggcttccacaagtattataccatgtgtttccccagctggcgtactccccgagaaaaaccttcgaatcctgcgcgcggaagttatcatatctgtgataattggcaagaaaccatattttaattctacagtactacattataaattatgtgcatcccctagttttcaacagcacaatatgtcttgtatacaaactgaaatccataaaaagggatgtcggttaatattgatttcccgactatccccttttaatgcattcttcttcccgatatccatccacatgaataattattatttaattctataacgtattacattccaagatatcggaggaagaacaaagttcctctgttttttatcaacttctagtaaatgaggcactactcggaaggggtttttaaaggtattgcctgcgaatgcctctttttcatataattgtcgaaattcaatacactctgcttctttaaactcctgtatggataattcaaaaggtatatccttttgcttactgaagttcacagcaaatacaacaatttcctttttctcatcattatatattactgcgctttgtattacgggaagttccccatattttccggcatcctctcttggtccttctgccgattgtttcaatacaattcccttccccaacagtgcaacatctcggaatggataaaaagttgtctgccgaaaacatcccccattaggatccaccataatcatggaaccaattacaatcgattcacatgctacttttactacatcgcatttattaatcatggttatcataaaagcaccatgaagaactgcatccaatgcagttgacgatcttttatcatcacaaatttctgtccattgtggatatttttctttttcaaaattcttgctgcttagtattccccattcgtcaaaactgatataaacagatttactacatctttttttaccctgtacaaaacgtgatgccgccattatagtatcaatataattactgatatctattggtaaatgagcgatattctccaaagtatctgtattcattgcgtacattcccgtatcggggttatatgtataatatcgatgtaaagaaatatagtctatatcctcatatgcttcttcaagtactattctgtcccactcaggataagttttcagatcaatctccggactgcagcttccacaaagaacaagtttaatagatttatccatttttttcatcatccgggcggtttcgactgcttttctcgcatattcaacaggtgttttatgctcgatttgatgaatgccatccatttcattaccaagcccccataacttaacattatgtggattttgatatccatttttccttctttctactgcccatttggtattaccatcataattacaatactccaattcctccaaagcttcctcactggttccagtacccaaatttagtaccagcataggttcaatatttagctgtctgcataacgtacaaaattcatcaataccaacctgattgctttcttcctgttcccacgcgaggtcatattttcttatccttttatctcttggtccaataccatccttccagtgataacctgagacgaagtttccacccggatatcttataaacgtagtccccaagtctctcaataaatccaacacatcttttcgaaaaccatttgcatctgcctgaggatgagaagggttataaagacatccatatacgatcgtgtgtatatgctccaggaaggtgccatatagtctctcatccactttacctacagtaaaagctggattaacaattattttttgctttattcctttttccatataatcttatcctcattgcattctctgattacatctaactcttcagcatcataaggagtaaaatctgcatgatataaatcatgcatccaaagcgaaatatcaattcctggataatcttttatgaaatcccaaacaatattgaattgagttttcccatttaccagcccaaagaaataacttcctattttctcttttttccataaaggaagatgggtttgtattaaacttctaaaaggtctgtgcatccattccgtattgataagtggtctgttaaactgccttaaaaaagtaataagctgtctggcatgtgtataatcaccataaaaatgaaaagtaattatatcagataattctatattttcccgatcaacttctccataaatctttggatgatgaagccattcataataattttttccatccgtctgcgccccccacatttctattgtcagtggctgctttacatcctcctccctaaaccagccaataactttacgcgccatcggcatcgacattgcatctcgtccggaatttcccaactcattccatatattccagataataatcctgtcatcctgaccataaacccttgccaattcccgaatatattcttcaacaacaggctccatatctgtttcatcagtaatattataaccaatggaatctccactctgcgtatccacatcaaaagaattcaaagaagagccaccgaaaaaaccttcctctggttctggctggatccccagaaccggctttttataaaaagcttttgccacagtacaatcattaaataaaaccggcattaatgtcattccataagaatccagaagcgatataaattcttcaagatttttcataaatgaatcatgttgttctttccaaagataaaaaggcaaaaaaactctgacactattcaattttaatgaagcagcaagtgcaatctcctttgcagcttcgttaaaagcattcctatgatcatgttcctgaagcaaccataagattcctcccgtagaggtactcggtacaaagttaaatcctgatatccactcatgatttttataccatttccatatttcttcttctgtccattttcttttcattcattcccctcctattctttaactgatcctaaagtaattcctgttacaaaatatttttgaagaaaaggataaattaataaaattggtattgtagaaacaacaattttagatgcattgaatgttctttgggacattctgtcggcaagctgttctgcagaaagtcccgattgagtaatatctgatattctaataaccaatgactgtatataagtctgtaaaggcatcttctccggagtattcattaacaacatcccatcaaagaagctgttccaatgatttacaatactaaatagcgacactgttgctatagctggctttgccaacggaatatatatctggacaagcattcccaaaggtcctataccatctaactgagcagattctttaattgcttttggaatatttctaaaaaagttgataaccagaattacattaaatacgggtacagctcccggcagaacaagtgcccaaatactatccagcattccaagacttcttatcacaaaataccatggaaccacaccaccattaaatagcatggtaaaaattaatagccacatatacctgtctctggatggaaattgtctcacctccagcgaaagcggataagccattaatacagtcagaaccatatttataatcacccctaaaaatactcttttaacagacatccagaaagataaaaaaaatctgttttcctgaagtaaatatttatatgaatccaaagtaaaatcaactggccatagagatactttcccagcaatcgctgcttccttcccactaaaggaaagtgccaatacatttattagaggcaatatacagataacaaaaatacaaacacatattattaatactaaagtgtcaacaatacgattttccaatgaattatagtgttttttcatatatatctcctaaaaaatccggtaattggcaaatttgtcagccattttataggatgtaaatattaaaataaaactgaccacagatttcatcagccctacagctgtagccagtgaaaattgtgcatttaggaaccccatccgatatacataagtatcaattatatcccccgttctgtaaacaatagggctatatagattatatatctgatcaaatccggcgttcaatatatttgcaatattaagagttgctactaaaacaattgtctgacggattccaggtaatgttatatgccatattttctttaaacgacctgcaccatccatttctgctgcttcatacaattccgtattaataccagccaaagcagcaataaaaataaccgcattatatccaaattctttccatacttcacttaatattaccactggctgaaatgttgcattacttcctaaaaaaacgataggttcttttattattcccgtacctgctaaaatctgattaataattcctccagagtccagcatatctctaaatatagttgccagaataacccatgatagaaaatgtggaagataagcaactgtttgcactactttttttgcctttaccatttgtaattcattaagaagaatagcaaaaacaattgaagcgagcagcgttaatacgattttccctactgcaataacaagcgtatttctgaatattaatatagtgtctggtagctgaaacatatacttgaaattatcaaatcctacccattctgaaccgcgaatccccattgtgggaacaaaatcctgaaaagcaataattattcccatcataggtactattgaaaatataaacagacaaacagtacctggaagcaacataagatgatagggcaacgtattaatttttcttttttgcatttttttatttttccgcataaaatcctccaggtccatccaattttagataaagcatctgccaaatcacagtttacttatagtgcactgtgatttgcagatgcacattgtttacttaacccatttcatagttaatacgcattacttggatgataccatttcctgtaattctgcggtaatttcatcacctcccaatgatttccactgttctacaaatttatcaaattcatctattggcttttctccgagtataatctgaagaaaagtctcatcttcaagtttttccagcgttgcccatttcttgtccatagtttcagcctttgcatatgtagatgcataaacacggttcatatgatcttcagcctgcacaatagcatcagcccccctgtaccagcaataaccgttcgcctgcgtttgctgagccgcctgctgaataccattctcctgaacatattcccaagaatcatacatagattgtagacctttcgttaaatcatcgtaagaggcctcaccatcaattactgaattaactccaatcgcaattttttctttatcatcatatgtcgtcataagtacggcaaaaggaaacattgtccaactggagtatgaatcttctttcggcttcgtaatttccaaatctccggaatctactcgtctctgcatattcagtgtttttataacagcttccaaattctgataatcttttctcactaccaaatatgtcgtacttggattcatcatatgtacattgtaaatgccattatcatccagaggcaccgcatagatattccatttcacactatcatccgttttccacatatccgataaaggccattgcaaattccaccatgaaccgaagaagattcctccttttccacttgtaaccaactcattacattggtcggaatcttttaccgcaaaatctctgtcaattatcccatcagctactaattttgcaatattttcaagggcagtcttagtttctggttttatagatccatacattacatttccattatcatctgttacccacatttccggatatgaattatacaatgcaaatagtgcatctaatccatacatattatttccaacactaacaatagacttggatgctactaaacctaaagaaccttttttttcttgaaaaagctttacaatgttacatatatcatccaatgtctttggatcctctatacccagttcttccatccaatcacctcttacatagagaagaggaattccgtctgcaccaggattaatattaggcatagccataagttttccatcaaatgttgcactatccaaagctattccatttgttgtagcatatgcctcttttagttgttcggaggcataagtattataagcatccgttaaatctgcaactaatcctgcttttaccagctgtctcatctgaggttcagtaactgtcataacatcaggcaaatctcctgttgatattactaatgctgatttctgattatatgcatcggatcccaccgctgtccatgcatattcataatcaatatttagctgttcttcaaaccatcttagtacataattatcgccagatgtatccccattttcataggaatctgaagaattttcactttttccaatacttattgtgaccttctcctttaatggcttaaacccatcatcatcttcatcacgtacatatgactgttgtgtttttgtttctccatctgacttattttgattctgttctgaattgtttgaagcttcacagccaatcatcgacataatcaatgtacctgtaagtaatactgctacaatctttttcctcatattcactctctccttgtgcagtgtttttaactacaaattaattgtacaatgattatctataataacatatggaataatgttcctagtttggtaatattttttctaaaatactttttctgtatttacttggtgatgtacctgtattttttttaaatgctttaaggaaataaaagtagtcattatatccaactttttccgcaatttcttcaattgaaagtttatcatctaaaagtaattctttcgctttctgaatacgctttcctattaagtattctgaaaaaggcatccccaactccttttttaaaatattactcaagtatcctctgcttacaccaaattcttctgccagttctcctaatgcaatagtgttatcaatactttcactttttactttcattactattgaatataataaactatttgttacatacccttcctcctgaaaactattctccacctcttgcttaacatactcaaagaatttttcaatttcgctaaattgtatatcgatctgataatagttaaaatattcaaaagctgctccttctgtattcagcttaattgcaagttgattatatagtaaagcaagctgatctatataaactcttccctctttcatttctttttctaattcatgaaacaatattctcaattgattaatatttttttcttctagcgcctgattcatataacataaatattctttcagtttttttctacctacttctctatttttcgaaaaatccatctccccatgtccataacaaaaatcctcagtacataaagcaatattggattcttccatcaattcaattagattatctccattataagacttaccgctgaatccaattgccctgataccaggaaaaatatcctttattaattttagaacacttttttgtttaagtttttcaggatactttaaaaaaactacgattctatttttttcacgagaaagagtaaaataaaagaaatgattttgttccattaaaccatttttctctccattccattcttcttcaagtaaaagagacatacattgatagaccaattgcagagattcttctccagaatccaatttcttataaaaacagtctgcttgaacattaaatactttctctaaatacaataatttactatcgtcatcctgttctttatacaatctgtctaatactgcatccaaaacactcttcaaacggttttcgtcaattggcttcaacagataatccaacgcacctaaatgaattgctttttgtacataatcaaattccgcatatccgcttaaaaatatcactttgctgtcaatttcacatgcattcatcttttccataagttccaaaccatccatacctggcatacgaatatctgttattaatacatctggctgaagttcgactaacatttcaagtgcttcaattccattttcagccattcctactacttgaaatggaagatttattttttccaacaattgctttatccccaataaaacccatctctcatcatctgcaattagtattttatacataagctctccttttacaccgtttctgcaaaacctattactaccttagttccctttcctctttcacttgtaataaataattccatgttattatcatatgtcagctttagacgttgatatatatttactaatcctatactttgactaccattctctttaccaatttcatcatctctcatagaattgtatatttcctgtaaacgctgttcgttcataccgaatccattgtcctctacacttagataaatccactccttttttgttttaccatttactttgtatatttttatccaaacttttccaccatctatcatcggttctaatccatgaaatactgcattttccactaatggctgaagaataagtctaaccattttcttttccagaagtgtattatctatttccagttcgattcttatttttgaaaatctgcattctattatttttgaatattcctgaatataatttagttcgtctttgatacatactatattttcacccttaactgcataccttaaaacattagataaagctactgtcagttctgaaacattctcacatccctgatacatagccattgcccttatacattccagagtattatataaaaaatgaggatttatctgatttctatatgcaagtatttccatctgtttcttagccaactgtgtttcatatattttcttttgagaatcttgaatttctcggttcattgtatctctttcatccaacatcctatttaaatttctggtcaatgttcctatttcatttctacttttataatccattctttcatcagtatgtgtagaattcctctttacaaataaatctatctgatgaagaggattaataatagccttataacaaaaataaaccaataaaactaaaattccaatagaaaaaacatataacattttcatttctttatttagaaaatcaagcccctgaagaagttctgttattggaacataactaataatagtccatccatttctgtctattttcatttcagaaacatagtatctgtcttttattttttctaaattctggaggaaatcctgatctttttttgctatagaattctgagccagtaaatttaattctttatctataacgtataaatatgtatgatcagtaattctaacttcatttaaaaaatccgttatattttctacagacaagtaaaatacacagatccctaacttggtaaaatactgaacatttttcaaatcatatataggataatagattgcatactttacattatctccatcatcagacaaaatttgttcggaatatacaatagtgttaatatcttctggtgacactgtcgatgtatatcttttccctactcctaacagtttatttccttccatattatataactcaattcctgatatataatcatccgttataagagtattaataagtacatcctttaaatcatcctgcataagggggcgtttttcttcttccttataataagcatatacaacaggattataggcaacacttgacattaaattttgcatcgagataaacatttcatccattttcccaattaattgtgttaaaacattttcatttaactgcagcgtattatttctggttatttttttcgcattatattgattcatagtaaatactgttgtaacaataagcaaaagcagcaaaatgaaagaaagaaattgtataaataggttttctctgatttttttcataatatttccggataacttcttatccgttcctcccctctcctgttaaatcacaataaatatttatttgattataatctatataaaataccttttcaaactaacaccattaattaatttacatctgcaataataaataaaatttgtcgtattcggtgaacggcattcatcaacgtcaaaagattataatcgcgatattgaagccgtaatcggatcttacggcatatatataatgtgacaaatttaacttaccttttaaaaaagtatgtaactatgcaaaaggggtatttcatactatgacaaggacaagcgctattgaaaacggttgccaatttacactgtacttaaaatcagtcatacattctctcttcatcgtcaggtgctatatccaacattatagtcatatttgatgggtttcgggttaatagaataacttacagaaaaccatgcaactgtgatgacaaaatttacagcttttaaaaacaacttattcgttgccatgaactttgataataatggaatgccatatcgtgtcatcactaagaacccaaaacaatttgctgtacatgtggatagagaagaagagaaatacccgccttttaggtgaatagtgatggcacttttattaataacttgtttgttgaatcaattggataggacttatacagaagaactgtccaaaaacttacccctacatcataacaatctaatgacattctttcaggcagaattaaataatctgaaacaaatgggtatttgagaaatattgaaatagttaatattccggatatgaatgtacttaatatacttgttgataaggatggcaatgtgtgaagcattgaaccaggacagggaattatatatcgcgacgcagatgaaataccttattttggttatgacaaacttttcatttcttgatatggagagctatgaagagtatggcgaagttgctgacagatacgaagcagtaaaaatatgtgtgaaaataatcttgatttgtatatatatggcacctttgaaatatcaagtgcagttaagaaactcagcagagagtggactacagcattttccatagtatattctcataaaaaacgaactgtttactattgaaataatattattgtgattacaaaaaatttgctatccaaaagtatgcaaaataaaaaacagcggactccccacaaaagggcttttccgctgtttcaatcataatagcgagagggggacttgaaccctcgacaccacgggtatgaaccgtgtgctctagccagctgagctatctcgccaaattatatgggacctatagggctcgaacctatgaccctctgcttgtaaggcagatgctctcccagctgagctaagatcccataatcaaacaagttttgaagcgctttaatatcgcacccgcaacctgcttgattagtatacaaaaaatgggacaacttgtcaacaactttttttaaattttttccgcttcttttttatccttcagacactactttttccttgcgaaaacctttgttccaaaaggcggcagttccagttctccctgcacttcttttccttcaaataaatccagaaagcgttctttcagacagatttccgccgcttcctccagataattcagcacaaagaaatactgacttccgtcctgtgcctccctgaccatcagctcgcatccctccggaagggcaattatatcctgatagggctgtgccgctcccagcttttccagaaatacctgggcggtgtgctcattaaaagcgcctccgaaataataaacccttcccttacctttttcattgctgataagggccggtgtccccgcatagtagctggaaacatatctggcctccactttggcctgatccgtaaggggttccagcaaatcattgaaaatactggcttctatctgcacgccgtcccaatccgcgtaaacggttccttctgccggcgaaacaaatgtatattccggtatatcggttcccgcaagaggctgcagcaggccggggagcttactcatcacacactttccgttttcctgcttatagccggtgcggcagcccagcacaaggcagccgccctgctccacataagcggtaagcttatccgccgtttcctgagtcacaatggtggcatgaggatagaacaggactttatacgggaacaaatcctccgcccgcatatgatccagatagcagaaatcaaagggtgtatgggttttctggcaggcggcgaacaatcctttgctgctttccctgtccaccctctggtgccatctgtccagaccggcatcccagatgttatcatagtccttcacaatcccaacctctgcccggtaatgtgcaccggttacaggagcgagagcgccgacctttttatgaatctccttcacttccgcaagacgtctgttatccctgcctgaataatccaggataccgtgccagtaaatctccgttcccacggtacaggtacgccagcggaaatagctcacatagtcggctccatggccgatgctctgcatggtccacagggtcatctgtccgggcttgggcgtaggggcttccatacgggtattccatccgttggctccggactgctgctccatgattccaaaaacaggggatatcgccctggcctccgccagattcctgctccattttctgtccctcattttcccttctcccggttcatagtcgtccaggcagtatgcgaaattaggatatgagtcataggtaatgaaatccaaactttcctccgtcatacgatggttatccagatttccgaagagtccgtttgtggtgataaaatcgcctggctttacgtattttttcaggatatcgctctgcatcccggcaaaccggcaggcgctgtcggacacgaagcggacataatccagcacttcatggggattggttgaattactgggtgtagggcggggaacatagatttcttcccagtccgtataggtctggttccagaaaacagtgccccacgcttcattcagcgcatccagggtgtcatactttttcttcaggaacgcgcggaaggcggcggaatcgctctccgaataaaattcgctcgtttcacagttcagttcattgtcgatctgccagcctataatgctggaatgggatgcataatgggatgcggatttctccacaatcctttttacaagttcctggtatttaggggaattgtagttatagtggcgtctgcagccatggcggtagaggacgccgtttatgttggcattgagcacctccggatatttgttggtaagccaggccggcggggtcgcgctaggtgtacagaaaatgactttcattccggccttttccgccttttccaggaaccggtcgaaaaattcataggtgaattccccctccctgggttcgatcttgctccaggcgaactcggcaatacggattacctcgattccgcttgccagcatacgctgcagatcctcttcccacatttcctccggccagtgctcaggataatagcaggttcccaatgttattttgtccagtttcatacttcgttccatttttctaatcctcctctgattcgaaatcctttatttctgcttttattccagttttcttacggaatctccctttatcagctttatcggggagcctgatacatatttcacctttttcccttccagcatgtccagcagggtatccacacatctggctccctgcttctccggaaacaggcctacggaagtaagacagggatccctgtattttctcgccgagctgccgtcaatgccgatcagggaaatatcccggggcacctgtatccccagcgcatgaaatcttttgcacatccccagggcgaactcatcattaaaggccacaaccgccgtggcatcgattttcctctccgcaaacagctgggccgccagctctccttttccgaaaaaatcttcttcgggcagatacataccgctctcccgatcctcgtcttcctgaaaagcaagaatacggggatcctccggaagttcttcccggtgtataccgatatagtaatccttgatccggttcccatatacttcttccatcagagaacagaatgccaggcgccttacgtccatagtccggaaaggataaggcatagccagggccagacgtttgtgcccgtacgctctgagctccctgacggcaagctccatcactttttccatatcgatttccacacgggggaccgcacgggaaaagcgggcggggttcccataggaagcagctatgacagggagcctgtaattcctgcccaccgtatccaggtagtgctgggtgactacctcattcggcatgatgatgccgtctatcatggcatcgcggattttctcaaagtccatgctgccgttgaagaccatcatataatcccgcttccttgcggcttccaccattccctgatacatatcgatataaaaggaattccgcagatccttacagaaaaaaaggagctgctttgttcggcgcttctgcagcgcctccgcgacaggatgaggataatagccaagcttatccgccacttccagtattctttttttcttttccgcttccacgtatccgctgttattcatggccctggatactacggataccgatacgcctgctttctcggctacttcttttctggtgaccatttttcctccctccttgcggcatttcccggaaaccatatagaattcccttttgcgtttcctctaaaaatatcttaacttttccctggtatactttcaatagcggaatatgtggacgcgcgtccacatattgtcaaagatggggagacagcccatttatccgtttggactgtctcccggaatttatttgtttcctgctgttttgtttattactttcctgtcaaagcatcatagttcgtctttgccgtttcccaggcatctttataatacgcggtcacttcatcataccccatatttttcagttccgcctggatttctgcaaatttctggtcgtactcttctcttgtttgtgagaataccatagcaggaaccgcctgctgcagataatcgctgatctttgttacgcttctctggatattcgtaggattttcggcaggcatcaaattgatatagccttcatggatggtggactggttttctcttttggtgctcacttccagaggtacatccacaccgtagaaatcacagtaatccttatccgcttccgtcatgttttcttccacgaattccttgtttaagcgtatatcaatgtagtcgcccttattcgcttcactcaccgcaagagcgtcataatcctggcctaccaggcccagataccggtttgccccctgctccagcaggtaatccggattatccttcattttctgcttgcagtcttctgtaaatacggcaacgccgttttcgtcataatcccatgtaatacctttcggtccgttcattatggatcttgcgccatcttctgaaaatacaaagtcaaacaggcgcataatacccttcagttttgtttcatcgcatttggatgagacaacaaacgttcttgctgccataccgaattcggaggctctggaaatccaggcagggaattctgccgtatccgcccagggaacatccacatatttgtcggtacctccgtttttgttcagttctgcattgccggcgtcaaaatcccattccatagagctgaagaaaacctgcccttcacttattttctggctgtaatcttcgtttttctgtgtataggtttccggatccagaatgcccatctgattcgccttaaaatacatatctgctgtaatccagtacatatggttttcattatacagatcgatatattccaaatcaggaatgctgaacgaacttaaatcattcagtccgtattgtgcacaatatttccagataaccggatcagaaagggtatggttcagcccccagtcattaaatcttgaaataccataggtctttttgcctgattctgtctgcggatggttttcctggatttttttcagcaggttaagaaaatcatcgatagaattaatttccgggctgcctgcttccttataccattcccagcgtatgaaattaccgtaccgggaggtcgccaacggggaaggctggttctttcctctggcacagatggcatacattttatcttccccattacttaagtagcccttgctgtaatttaccatttcagggaacccttctgccatgctgggagcatactgaagataatcatccaggctctgcaccgcgccggcctgaatcagcggagtgatatactgaagtcccatacggtttacatcatacaaatcaccgctcgccgccatagcctgctgcttctcattgctgaaaagcacaacattcaatgtaacccctgtctgttccttaatatactgggccacaggatcctcctggattcctgctgtcatcggattctctccggcggaatccatgaaaatatcaatcgtaacctcttctttttcatcggttccggcctgatctccttccgcctgtaccgctcctgtctccgcaggcgttcccccgctgttggcgctgctgcttccgctgtctccacaggccgtcaaaccgaaggcaagaaccgccgccataactgccgctgccatacgtttaccgctttttcctaatctctttttcatgagaccctcctttttttctgttacaggtgttcctccgggaaacctgaattttcattaccccttcacagctccgatcataattccgttgataaaatatttctgcataaaaggatacactatcaggatgggaactgtaaccaccatggtaattgtcatcctcagagtaaatggactgattgccgctcctgaaaccgcactcgcacctcctgttctggccatactcgcaacattcgtggcctggttcagatactcaagcaatgtcatctgcagggttttcagattcatattatttaccagcagcagattatccgtccatgaattccattggcccacggcggtgaatacaatgattgccgccagcaccggcttacagataggcatgacaattctccagtatatagtaaaataccccgccccgtctatcattgccgattcttcaattccccctgtgatggactccatataggtctttatcagtatcatgctgtaggcggataccgcagtaggcaatatgtatacaagaaagctgtcctttaagcctattgtcctcattgtcagataccagggaatcaatccggcattgatatacatggagacaatcgctatggagtaaaatatttttctgcagggaagctcgtttttcgtcagggtataggccagtatactcgtaaaaaacagagtcaccgccgtccctgcaaaggttctggctatggacaccagaaaagcattcatgataccgtttaatttgaaaacctgcacataattggccagggtaggctccaggggataccaggttatcatacttcttttcaccgcatccggactgcttatggacgcaataaatatgtaataaaaaggataaatacagctgataagcatcagtgtaaacaaaaggaccattgcagcctgaaataccaattcttttccgggtagcttctttttattcatccgaacacctctttcatccgttgaaacggaccctcatttcttctcttctttacctataatatagactgtcccagtgtttttttggaaagcttgttcacactgaatacaagaaccacgctgataaaggtctttatcatgctcaccgccgtagatgcgggaatatcattattcagcattcctatccggtacacataataatcaagcacctcaatatttttctgtatcataggattgacaaatacatagtactgctcaaacccattattcagtatcgcccctaccgaaatgatcagaagcgtgataaaggtaggcagaataccgggaattgtgatatgcagaatcttctgccaacgtcccgctccatccaccgccgcggcgtcatacagctgggaatcgattcccgtaaccgccgcgaagaaaataatggaattataacccacggtcttccagatatttgtcagcaccataaaaagctttgccgttcccggattcgtcagcagtgtcaccgtggaatcccggttccccgacagtccgcggacaagcgtggtaagcaggccgtcgttggaaaacagagaaaacataatggaataaataataatccagctgatgaaattaggtatggtaatcgccgtctgcacggttttcttgaatttctttccccggacctccgaaagcagaatggcgatcatccctgccagcggcagccccagcagtcccagaatactgattatcagcgtgtttaaaatcactgttattatgtaaggatccccgaacgcataaataaaattgtccagtcccacaaattcacatttggaaagcttgtagccgattctgtaatcaaaaaaagaatatatccatcctgatatggggaaataggaaaatacaagaataaacaaaaccgatggaattgtcatacacaataatgttattttcccctttgtcaaatgagttttcctcacctttgtacccattccctgtcctcctccttatttcactgcatttcggaattccttatggccgtttcgtttctaaggccattattgcatgcattttgtatatgttctatttcaaaaaacataggattgattataaaaaacataacatttcacatgtaaaccttatttttttacagcataatatctaaggtgatatcctttctgtaacgcaatctatggtttttataattcaatttttcaggaacaaatgatactatttaaattgaaataacagactgcagatcgcagtacagacagcagacgggggaactatgcagaaagaaaaaaagacttttcataaaatgcattttatatccaatgtatatcgctttattatttttctcatccttcttatcgtaaccatgctgatcctgatcattaactacaatttttccaggcagaaccatcaatataccctggattacaatatgtctgccgtgaaagggctgaaggaactgattgcggatcaggaacatttctttctccagcagctgaacaatacctatgaatcctattatgcctataaggaagggcttttttcctgcctgaattcctcccggcatgagtccttcccctaccggcagaatatttaccgttttttgaacgaatcctttccgcctaattccgaaatgagctctcttaccatatacgcggcaagtgataatcagatatattccgttaccaagcaggtccgcaagaatttttcagcctctcttccggaattttcgccgctgatcgaatgctatgagaaccccttcaccgtccttcgggtaatgccgtcgcagtcctctcagattctggaaacgtcacggggctacagcttcatttactgccttcgcgacgttatcactaaagtcaatatcggagcgatccaggcggactacagtgtatcggaggttcaaaagtttctgtcctccaattatcccggcgtaaaaggggattttcttgtcattgatttggaaggcaatgttctgttcgatacctccggttcctggtatgatgctcccttcccctgggcagaaccgtttatttcctgcaaaaagatggacaacgtgcttgtgactctggatcatgaaaaatattacgtaaacatggaagctcattcctatcccaacatccgggtcatcggcctggtatcccaaaaaacactgtccgccgatatacgcaaaaatattgccctgatgctgctggcgacaggaagcgtgaccgccctgacctgtatcggtatttacctttatttaaacagcagctcccggcagcttaacctgatatacctcaccatgctccggatacagaacggggagcttgattcttatattcccgttgataataaacataaaaatgaactggttgacatctccgtctccttcaatgacatgctccgtaatctcaacctgtatatcgataaggtatataaaaccgagatagaaaaccagcgctacaagctgaaagccctgcagtcccagataaatccccattttctttacaatacgctggaggctatccggatgaaagccgtcctgcaggaggaaccggagatcggggaaatgatatatatcctttccaagattttcaggaattccataaaaaatgaaagcatacttcctgtccgccaggaaattgaaaactgtaaaaattacctccgtttatgtgatatcgaatataagaacctcttccgttatcattttcaggtagaaaacgcactgctcacggaacccattatccagcatgctctccttgtcatgattgaaaactatatcatgcacggtttcgatagcaaccgtaccgataactatgtccatgtaacaggttatgtggagaacggctttgcggtattccgggtccgcgataacggcttcggcataaaaactacggagctggaaaagcttcgcctctccttcctggaaaaatccatcgatcatgtggaacgtatcgggctgaaaaacatctatcagcgaatgaagctgctctacggagagaactgcgatttacagatcctgtcggaatacggacagggaacggaaatcattttttcattcatatacaaaggagaatcagtaaatgattgatgtaataattgtagatgatgagccgttgatccgggacgggctggtaaagcttttttcctggaaagattatcagatgcaggtaagcgctgtttttccaaacggttccctcgccctggaatacctggaaaagcatgccgcagatatcatcatcacggatattaaaatgcctgtcatgaacggcattgaactcatgcaggaatgccagcgaaggaaccttcctgccaaattcatcgtactcagcggctattccgattttgaatatgtaaaaaccgccgcaaggctgggaatagagaattacctgctgaagcctgtggatacccaggaaatgtcccagaccctcattcagttaaaacggaaaatagaagcgcagcgccagaataaaatactgctggaggagggaatccgcattctgcgcaataacctcctttaccgtatgatgataggcgaaatctcctatgaggaaatcgaggaacgaagggaatatctcagcattccctttgacagctgcggctaccgggtcgccatcctgaaattcctgccccagagtcccgacacggcccttcagaagcagcaaaagcctccgataaagtccgtactccgtcatctggaacaaaaggactatatccatgccgtcactgatttcggcggccgtctgctgtatctgctcttctgcggctgcagggctgttccttccggaaaggacgaagctgtcagagccgatttggagcatatcgtccagtatgtcctggccacctctccctttcatgcgtttgcagccgtgggcacattggcggagaacatcgataccataccggaaagctgtgccaaagcctttgccctgatcaataccgcgggctacaacagccccagcagcatccgctgggcagacgatgccgtcgaaaacgaagcgcttctgctgcctcacatagagtttgaccagctgatacgcctgaatgaaaaatttttatataagaaggaagaagatgtcatggctatcgtggatgatattttccgaaccaaccgttttattcccttagacggactgcagatgctctcctccatgattgtttccaaaatctactccaacagcagggcctacggctccgatcccgatccggaggtgctcagcctggaaaaccacctggaggatgcttacaccctttcggattatgactctatacactgctggacaagagatatcattcataaaatctttctttacgaagaaggaaaggactccgggaaaaatcaggccggagccacgaatatcaaaaaaatacttctgtatctgaatgaaaattatacaaaagacatcaacctaaaaaccattgcggaaaccttccacttaaacgccctgtatctgggaaggatactgaagctggaaaccggctgcacatttacggaatacatgaacaggctgcgtcttgataaagccattgacctgctgatccataccgatttatcggcaaaacaggtttccgaacaggtcggctacagcaacgataaatatttcaatactctgttcaaaaaatatacggatatgactcccggtgaataccggaaaaaggaggacttatgagcacaagaatttatgaagcactgaatgggaaacaggggaactacatccttccctttttctggcagcatggagaggatgaagaaaccctgcgggaatatatgggggtcatccaggatatgggcatccgggccgtctgtctggaatcccgtccccatcccgattttgcagggcccaaatggtgggaggatatggacgtcatcctctcggaagcaaggcagaggaatatgaaggtatggatactggacgactgccattttcccaccggctatgccaacggggccatggcggatgcaaaggaggacttacagaaatggaccgtataccatctgatggtggatcttgccggccccgcagatctgcgggtggatgtggattccctgctgtccggaatgggcatcggtttcccgctccctccggacgggccgctttcccagaaaaaagaacttttatgcgccgtattgtacgaaaggcaggatgaaacctcggatgccctctgtcccggatacaagctggtaaccgattccctgagaaacggcctgctgcccctttcccttccggaaggcttttaccgcctgtttctggtctacaaatcacgcaatgccggactcgccaacaacagctatatcaacctgctgcagggcgaatccgtaaaaatactgctggatgaagtgtatgagccccatttcgaacgctaccaggccgatttcggcacaaccatcgccggtttcttctccgatgagcccggcttctataactgtattgatacggtatttaatttcaatgctattgtgggaaaagaaaaaatgcccctgccctggtcaaaggaactggaggagctcctcctttccgacggaaacacctgcggtgatttggtacggctctggtacgatacctcagccgatgatgacgccgctttccgctaccggtatatggatgcggtcaccaggctttacgaaaaaaatttctccctgcagctgggtgactggtgccgctcccacggggtagaatacataggccatatactggaagacaacaactcctcttcccgcctcggccccagcgccggacactatttccgcgccatgaccggacaggatatgtcgggtatcgacgtggtaacctcccagatccttcccggacgcaaaaacgtccatactaccaacgccgccctgaattcgcagtccgacggggaattctaccattatgccctcgccaaactgggcgcaagcgacgcccaccttgacaaaaagaaaaagggacgcgccatgtgtgagatcttcggcaattacggctgggcggaaggcgcacaaaccatgaaatggctgactgattttatgctggtaagaggaattaatgtctttgtcccccatgccttttcgccaaaagacttcccggatccggactgcccgcctcacttttacgcccacgggaacaatatgcagtcctcttacctgaaatatctgttcctctatatgaaccgggtatcccacatcctcagcggaggaaaaagcgcttcccacgtgggcatcctctatcacggagaagcggaatgggccggcgaagcccagctgttccagaaaccggggcggttgtgcctggaatgccagacagactacgacgtcatccccgccgacctgcttgcgtgtccggaaagccttgccgccggtttgacaaccgataagttgcttatattgggcgatctctccctgcgctgtctgatcgtgccttattcccagcgccttccccattccctgcttcaggggctggcacagctttcttccctgggcttccctgttctctttgtggacgccctcccttctggttccagtgaaggaaaggatatggaaaaagaacggcgcagcctggaaagaagcgcactcgttcttcctctggcttccataaaggcttacctgaaacagcagtccctgccggtcgtcacattcccgtccggaaaggaatataaagatctgcgcgcttaccaatatgccgggccagactatgaatgcgttatgctcatgaatgaatccatcggcacagccatacacgacaaagtccgttttacctccctgcagcctgccctggaatatgacgcttatgaaaattgcctgtatcagatcatgacagaggatgactgtctccttttggatttggaaccgggagaatcccggatttatatatcccggcaaccggaagacgaagcttctctcccgaaaccgcctaagcaaagaccggtaaaaagacaggagcttcatggtgaaatccagctttcagcggcttttgtacaggagaaggatacaaataataatttcaggcccatgggcagcctggacagtctcacagacttatccatgagagacgaattcctcgatttccatggtatactccggtatgaaatggacttttccttccatgcggatgcacagagtaccggaaaagaaaccatcttccttgatggggccaatgaagtggtttccctcagcgtaaacggacaggaagcccttgtccgcatcggttccccctatcgatttgaggtggggccgttcctgaaggatggggaaaaccatctggtgattgaaaatattactgccgtattcccttatgtgaaggatcatccttctataaataccgggctgcatcctatggggctttgcgggaagatatggctggaaagctgagagcattattaaagtaaaaaagaaccgctgaattccacaaggaaatcagcggttcacctattctttattacatccggtcaggcgccgaaaatcccagcagatcaatgcaggtttccagcacatcctttgtcaggacaagcagtgcgatcaggccggcctttttcgtctcatcctcctcagcgataattctggtttcgtgatagaaacggttaaaggcgttagccagatcataaatataagcacataccttatggggagcgcattcggtgaaggcggtctccatcatggtattgaatttggcgatttccatcatcagtgccttttcatccggactgacggcgggggcgagctgaaccttatcaaggctgccgccctgttcctggtatttagccaggattgacttgatgcggacaatggtataaaggatatacggtccggtatctccttcgaaggaggtgaaacgatccacatcaaagctgtaatcctttgccgcctggttggacaggtcgccgtatttgatggctgccagacctacgatatccgcgatttccttcgcttcctcttccggcatgtcgtgacggctttccatgattttacggagcatttcttcatcgatatccgatatcagcttttccagtctcggcacgccgccgtccctggtcttaaagggtttgccgtcttttccgttcactgtaccgaagccgatatgaatgagcttcacatcgtctcccacaagctttgtcttgcgcgcgcagcggaaaacctgctcgaaatgcatgctctgtcttttatcggtaatataaatcatgatatccggatcatattttgtcacacgttcactgatggttgcaagatccgtggtgctgtaaagcgccgcgccgtcggatttcaggatgatgcagggcgggatttccttgctgtcggtttcttccttcacatccactacaagggcgccgtcactttcataggcataaccgccctttttcatggcctccaccatttcggggagcagatactgtacggtggattctccgttccagagatcgaattccacattcagcttctcataatttttcttcatatccgctacggatactctgataatatgatcccacaatgcccggtggcctcttaccccattctgaagcttgaaggtattttccatggccttttccttgtaagccggatcctctttggacttgccgctggccgtaggatagatttcctccagttcagcgattgtgaagggagcctcctgaggatagtcccccgtatagctctcgtcaaaatagggcagctcaggctttctttcctgaagctccgtgatgatcaatcccatctgcaggccccagtcccccagatggatatctccgataaccttatatcctgcaaaacgggcgattctcttaacgctttccccgatgacggcagaacgcagatgccccacatgcaggggtttcgccacattcggtccgccgtaatccacgatgatggtcttttcttcagcgggcatttccattccgaatttttcaccggcttccatttccttcagatatccgcacaggaaatcgtccgacagcttcaggttcaggaatccgggagccaccgcttccacctgggaaaaagccttgctgtcttttaactgctctgccacctcattcgctatcataatgggggctttatggtatttttttgcgccggccatagcgccgttgcactggtattcacacagatccgggcggttggaaagagttacctttcccagttcttcttcatagcccacaccggcaaatgcttttttcatttcctcggaaattgcttccagaattttcttcatttaacaaacctcacttctcactgttccgccggtcccgctcatttttggaaaaaatgcagccgcagtaatcctggcggtacagaccatatttttcagaaagttccacagaacgtttatagccattcttctttttgaaatcagacggaagaaacgggacgccgtactgtgcgccaagcttctctccgatttcattcagcttgtccgcatttttcaaagggctgattgtgagggttgtggtaaagtagtcaaagcccttttccccggcaagccttgcagtctcacgaagacggatttcataacagcaaaaacacctttcgccgccttcgggaatctgttccagccctttcaccgcggaaaaaaacacctccggttcatatcggcctgtttccatcgtgataaaagaaggggcttccctgttcatttcctcaatcagtcttttctgctccgccgtccgtttttcatactcctgccgatccgttatattgggattataatacaggacggtaatatcaaaaaaatcacgcagatattccagcacatagctgctgcagggtgcgcagcagctatggatgagaagcttcttttttccggtcacagggacggcctgcgggtcatggcagccgctgttttcttccggcagtctgcggaggatatcctccagctgtttctgatagttcactttattcataatattcgtttacagctttgcaatatcaatcagagataattcattactctttgtttccagacttcccacaagggctcttgcggtatccaggctggtcaggcagttcacgccggtttcgatggcggttcttcggatgaggaaaccgtctctggatttgtccctgccctgggtaggggtatcgataaccaaatcaatcctgtgtcccagaatcagatccattaccgtaggggattcctggttgatcttattgacctgacgcgcctttattccggcttccttcagcgctgccgcggtgcttctggtcgcatagataatatagcccagcttttcaaaacggcgggcgatatcaatcgcctctcccttgtccgcatcctttacggtaatgatcatctgcttatgcctcggcaggtcgatgcctgctcccaggaacgccttataaagggcttcgttgaaggttttggcaatacccagacattcgccggtagatttcatctccggcccgaggctgatttcagcgccgcggattttttcaaaagaaaatacgggcattttaattgccacatagcccgcttccggctgaaggccgggttcatagcccagatcccggattttctttccgatgatcacttccgtggcaagatccacaatggggattcctgtcaccttgctgatatagggcaccgttctggaggaacggggattcacctcaatgacatatacatcctcgtccaccacgatgaactggatgttaatcaggccgattacatgaagggatttcgcaagctttctggtatactccgctatagttgcctttacgccttcactgattgtctgtgcgggatatacggaaatactgtctccggaatgcacgcctgcccgttcgatatgttccatgatgccgggaatcaggatgtcggtaccgtcgcagacagcatccacttccagctccttgccctgcagatatttatccacaaggataggatgatcctgtgcgatgcggttgatgatttccataaattcttccacttccgtatcggaaatggctatctgcatcccctggccgccgagcacgtaggaaggacggacaagaacgggataacccagtctgtttgccacggcctttgcctcctccgccgtgtatacggttccgccggagggtctggggattccgcattcctccagtatctcatcaaacagctctctgtcttcagcggcatccacattttccgcgcttgttcccagaatgggcacgcccatcttcatcaggctttccgtcagcttgatagctgtctgtccgccgaactgtaccaccgcgccgtcaggatgctccatgtttaccacgttttccacatcctcaggggtgaggggttcaaaatacagcttatccgcaatgtcaaagtcggtgctgactgtttccggattgttattgacaataaccgtttcatagccttccctggaaaaagcccaggtggcatgcacggagcaatagtcgaattcgataccctggccgatacggatagggccggaacccagaacgagaacctttttgcgcgcattcgtttccacggcttcattttccccgccgtatacggaataatagtaaggggtgctcgcttcaaattctgcggcgcaggtatccaccattttataagaggcaacgataccgttgtcataacgctgctgcttaatctcttccgccgggattccggtaagacggctgataaccgtatccggaaattcgatccgtttcgcttctctgagaagttccggagtgagagggcctttggcaagagcctgttccatttccacgataatggctatcttatcaataaaccaatgatccaccatggtgatttcatggatcgtgtcataatcgattcccttacggatggcttcggctatcacatagattctctggtcatccacttttttcagacgctctttcagttcttccacggaaagctctgaaaaatcatagctcatgaggcagtccacatgctgttccagggaacggatggccttcatcagggctccttcaaagctgttgcagatgctcataacctctccggtagctttcatctgtgtggtcagggttctttttgcagtaatgaatttatcaaaaggaagacggggcagcttcaccacacaatagtctaaagtgggttcaaagctggcataggtctttccggttatggcgttcttgatctcatccagcgtatagccgagggcgattttggcggcaaccttcgctatggggtagccggtggccttgcttgccagcgccgaggaacggctcacacggggatttacttcaataacacagtattcaaagcttacgggatgaagggcaaactgtacgttacagccgcctgtgatctgcagttcgtcgataatattcaatgcggcgctgcgcagcatctggtattccttgtcactcagcgtctgggaaggggccacaacgatgctgtctccggtgtggacaccgacaggatcgatattttccatgttgcagaccgtgatacagtttcctgcactgtcgcgcatcacttcatattcgatttccttccagcccgctatacagcgttccacaagtacttcgcccacacgggacagacgcaggccgtttgccagaatttcttccagttccatctggttatgggcgataccgccgccggaacctcccagcgtataagcgggacgcagcacaaccggatatccgatctgttttgcaaaaacaacgccgtcttcgatattcttaactaccagggagggagcacagggctctcctattttttccatggtatccttaaattcctgcctgtcctccgccttgcggatggtctgggaagtggttcccaaaagcttcacgttatgggcggccaggaaaccggactcatccagttccattcccaggttcagcccggcctgtcctcccagggtggggagaatgctgtccggcttttctttttcgatgagctgttccagcactttaacggtgaggggctcaatgtatactctgtctgcgatgtccctgtctgtcatgatggtagccgggttggaattcaccaggattacctccacgccctcttccttcagggaacggcaggcctgcgtgcctgcataatcaaactcggcagcctgtccgataacgataggaccggaaccgatgaccattactttttttacatcaggattcttaggcatgctcatttcctccattcatcatcgtgataaacctgtcaaacagaaacccggaatcttgcggtccggggcaggcctcaggatggaattgaacggtgaaaatatttttacccgtatactcaaggccttcatttgtcccgtcattgacattgacgaaagcaggcgccgccacttttggatccagcttgtccatatccactacatagccatggttctgggaagagatatataccctccctgtagtcagatcctttaccgggtggtttccgcctctgtgcccgtatttcatcttgaaagtatcggctccggtagccagcgccatgagctgatggcccaggcagatggcaaaaatcggaatatccgtctcatacagctttcttatttcccggataatgctttcgcattccttgggatcccccgggccgttggaaagcatgatgccgtccggcttatccgctataatgtccgccgccgctgtaagcgccggatatatggtcacgtcgcagcccctcatggcgagggaacgggcgatattgtccttagctccaagatccagcaaggctacttttttgccggctccgtttaactgcttcaccagagaaggtttcttttccttgactccggacagaaagctttccttattaaatacggcgcttccggaaatcggcccgttttcagccagatccttcgcaccctttatttcatacttattctcacacgtcaccttttccacaacattccctgtggtatatgctgcgaggcggggaaggatttcctccaggctgtaatccgcattggtggttatcatcccgttcatggttcctttttctctcaggatcttggtaagtgccctcgtatcaatgcccgcgattcccggcaccccgaagctttccagatactcctgaatggtacagtcggatcggaaattacttggcattctggacagttctctcacgataaatccgtccggccatggtcttcttgattcgcaatcttccttgcatacgccgtaattgccgattaacggatacgtcatacatacggcctgtcctgcataagagggatctgtcaacacttccagataaccggccatcgatgtattaaatacgatttcactgattatctctttttcggccccgatatgaattccttcaaataccgtgccgtcttccagtatcaaaaatgccttcattttcatctgcacatcctttcccataatcgattaattgtatcacaaatgatttgagtgttcaatcattttttccattgccttccgccttttcataacagtacagcccctctccagcctctggtcctgtgtatcctgttcggccagccttcctctctccgctgccgttcccggccatgcagaggtccttgaaggggacgctcccgctcggataaacacgcagcggtactaaggctgcacagaacacagcctaaggaccggcgagtttatacgccccttacaggatcctctgcatggccgggaacggcagcggagagaggaaggctggccgaacaggatacacaggaccagaggctggagaggggctgtactgttatggcttatcaccatgtgcattttttgtcataccatggaataaagagaaaaagcaggtaattttatgtatcagaaacaaaatagctgtcatccatgcggcggctgtatccccaataaagcccggctgtccaggccggcttcaggcaaaccggcaggccttgccgcttacggaggtctttataacagcggaacgcagcttgtttttttcactgctgctgacgttccggtacaggtaaaactgaatactcccatgccgcttaaaaatgtcactgcagtcaataactctctgactgtacagactgccggggattatgaaatcaattataatatccttctgaataccagccaggcttccacagcggcggctgccgtacgcaggaacggggaaatccttacccagacgagaggttcccagaccctggcggaggatgacactgccaacctctcctttgacgggcgtttgtcggcaagtgttattgttcctttatcttcgggtgatgtattggatctggtgctccttattgtgagaacccttcccgataatctgaatgcaataattaataataatgccaatgccactttgagcataaaaaaactggacagctgatggctgtccgaaagaaatcccacggcataccctgccgtgggatttcttgtctttctattattattgtaaatgtaaggcaattccttacttgaagtaagcaaccccggattcaaagatcttcaaatcctgttctccataaatattaatggcgactccatctcctcttctttccacatgggccattttgcccaggatacgtccgtccggagaggtgattccttcaatcgccgcataggaaccgttaacgttccattcttcatccatggaaacatttccttccggatccgcgtactgcgttgccacctgtccgttggcaaacagctttttgatccattcatcgtccgctacaaaacggccttctccatgggatgcgggtgttacataagtcttgccgagctgtgcatttgcaagccagggtgacttgttggataccaccttggtataaaccattttggagatgtggcggtttatggtattgaaggtcagtgtcggggaattctccttctgtcccacaatttcaccgaagggaaccagtcccagcttgatcagggcctggaagccgttgcagatgcccaggcacaggccgtcacgctcattcaccagcttcatgacagcttccttaatcctggcattctggaatgcggttgcaaagaatttggcgcttccatccggctcatcgcctgcggaaaatccgccggggaacatgatgatctgggcatcattgatcgccttttcaaattccgccacggattcacggatatcctcagcgctcaggtttttaaataccttggtcaccacgctggctcctgctctctcaaaagcctttgtgctgtcgtattcgcagttggttccggggaacacggggatgaatacgacgggcttcgccaccttctgtctgcatacatagatgctgtccgccttataaaggctgctttccaccggcgccgtttcctcgctcgctttggtggggaatactttttccagagtccccttccatgcgcagagcatctcatccagagtgatttccacatcaccgaaggtaaccacgggttctttggtaatggtaccgataagctcataagcggtgtctatcaggttgatcttatctgcgggaacctccgccatgatatcgcccagagcattttcaaagagttcttccaaatccgcgtcatcactcagctccacacccagatgattgccgaaggccatcttgggaagagccgctgccgcacccttgctgtccagcgcgtatgcggatataataacgccgtcgcggatcatttccgtaatcttgtcataaagctccatcacactttcataaacagggatatcgtattcatccctctccatgcagaagcgtactaccttatttcccggctttttgaattcgggtgtgataatatccttttccttagccacatccaccgcaaaggataccagggtaggaggcacatcaatttcattaaaggtgccagacatggaatccttgcctccgatggaaggaaggccatagcccacctgtgcgtcaaatgcccccagcagggcggcaaaaggctggctccaacgtttgggatcctccgtcatcctgcggaaatattcctggaaggtgaaacggatcttatggaaatcaccgccgctggcaacgattcttgccatggattcggtcacggcatacaccgctccgtgataagggctccaggaggaaagataaggatcaaacccgtagctcatcatggtaacagtatctgtttttcccttcaggacaggcagttttgccaccatagcctgcgtttccgtaagctggtattttccgccgtagggcatcagcacgctggctgcgccgatggaggagtcgaacatttccacaaggcccttctgggagcagacattcagattggaaagcagggtaagccatgcttttttcgcatcaccggcttccagcgtctctcctgcttcgggaacggcgtatttatcaaaatagctgctgccctccgccgggatatccacatatacgcctgtctcctgatgagctccgttggtatccaggaacgccctggaaatattcacgatttcttttcccctccaggtaaggacgaggcggggctcctttgttacaaccgcaacgctcacggcctccagattttcttccttcgcataatccaggaaagtatccacatccccgggagctaccacaacggccatcctttcctgggattcggagatggcaagctccgttccgtccagacccgcgtatttcttgggaaccttatccagatccacccggagtccgtccgccagctcaccgatggcaaccgatacgccgccggcaccgaaatcattacacttcttaatcagcctgctgacttccgccctgcggaacagcctctggatcttacgttccgtaggcgcatttcccttctgtacttccgcgccgcaggtttcaatactctcttccgtatgcaccttggaggaaccggtagcgccgccgcagccgtcccttccggtgcgtccgcccaggaggatgatgatatcgcccggatcggaggtttcacggattacattttttctgggagcggcacccataacggcgccgatttccatacgttttgccacataattgggatgatatacttcttttacataaccggttgccagaccgatctgattgccataagaggagtagccgtccgcagcgccgcggaccagctttttctgggaaagctttccctttaaggtgtctgctacgggaacggtaggatccgccgccccggtcacgcgcatggcctgatatacataaccgcgtccggaaagaggatcccggatagcgccgcccagacaggtggcagcaccgccgaagggttcgatttcggtgggatggttatgggtttcatttttaaagaaaataagccattcctcggtaacagggccgtctccgtaatccatttccacagggacgatgacggagcaggcgttgatttcatcggactcctccatatcctggagttttccttcttttttcagtttgcgcatacccatgagagccagatccatcaggcagacaaacttgtcctttcttcccttgaaaatctcttccctggtatccaggtagctttgataggtgctttctatgggtgtccggtagtagccttccccgaattccacatccttcagctccgtggaaaaagtggtgtgacggcaatgatcggaccaatacgtatcgaggacacggatctccgtcatggagggatctctgttttcgtcgttcacatagtaattctgaatatgctggaaatcccggaaggtcatggcaagccccagggaatcataaagttctctgagttcttcctccttcaggttccggaagccgtcaaaaatcttcacatcctccggctcctcaaaatttgtttccagtgtttccggcttaaccatatccgtttccctggaatccacaggattgatacagtaggcttttatccggtcaaattcttcatccgtcagctcaccggtaatcaggtaggtcactgcggtcctgataattggatcttcttcttcatttaagaactttacgcactgcagggcagaatccgctctctggtcaaactgtccgggcaggaactccacagaaaatactcttccgttctccggaacggtaatctgctctctgtaaaggtcgtctacaggaggctcggaaaacaccgttttgcaggccttttcaaatacctcatcgctgatatgctccacatcgtagcggatgaacattctcacatcctctacttttttcaggttcagatagttcttcagatcgcctttcagttccttcgctttcacagcaaaaggggctttcttctctacatagatacgtcttacatttcccatgaatggctcctccaaatgtttgtggccggcatttttttcatccccagccgccggctgctttttcctccgggcatacaaaaacaggccgggaggcgggcattctcttcttattatacaaaatctgcgttttttttcaatgcaatttaataaaatgaggggaaataaaaagatgggggtggggaaatgggggaggttgtggcctcatccggtcgccttccgtccgtgtttctccccggtggagctgtctggcctctctcctgcccgggcgcctgatctctgtagggacggcggcagacaaaaaaagggggagtttctaactgttttgttcctatgttcctctgccaacgcggcttaaactcctccttggcagtcgtcagacagcgccgctaagggcgggcagaggagcataggagcaaagcagtaagaaacttccgccctttttttgagatgccgccgtccctacagagatcaggcgcccgggcaggagagaggccagacagccccaccggggagaaacacggacggaaggcgaccggatgaggagggtagggtatggtaacgggagggaaaagggcttttatttatgattttattgcacaaagttggctaagggcgggtaacaggagcgcggaggcggggtttgtgtttttattcgtggaggcggtggatgatgcggaaggtgatgtcgccctggtttatgagggggtctttgtgggcgtagaaaatgatgccttcggtgggggccaggatttcttgtttggtgaagccttcgtaggaatcgaggatttgggcaaggggctggtggtagcggacgtattctccgggggcggtgaggcggcggtagaggccggcggttcctgcgtggacgttggtaaggtcttcgtcctggattacgtggctgatgtagccgctgtggctttcgtagcggatgattcccatgcgggtgaggaagcgcaggacggctccggtggcgcggacggcgcttttttcatcgagttcgtcggttttgttggtgtagacgctgaaggcggcggtggattggttctgccagttgtagttgagggttttggtgtccacggggcggggtttgcggatcactacatagggaaggccgaacaggttcgccagggacgggctttggaagccggtttccatcattcggacatgggggacgaattctccgggcatgtaaaagctggcaaactggatgccgtaggtgtagtcgcggatttgttccagcactccggcggcaatccgggaggtggtgtcgccttcctggtttccggggaagctgcggttgatgtcaatgtcgcctattccccaaaaacgtttgccggtgttgatggaaaaagggttgatggcgggaattaccatgatttctttgttggcgttgatgcagcctttattttccagttccttgagttgttttaccagctgggagcagatgtagagctgctggatttcatttccgcgtacggcccctgcaatgcaggcggctttttcgccttttccaaagcggtatccctgcaccagcatgtcttctctgtagttggatttcatccgaaataattccttcgtttccatttcgctctcctgttcactttttttcttcgattccggtaagaattcttgcgagaagggcgccttcatataccagaggatattctctgagggtaaagataaggcctgatttgtgcgcaaaaatttcctgttttactgttccattgatcacatccacgatttcgcctattttctctccctgtctgatgtaatggttatgtgcggcggaggggaggaacattccgttgacggatgctctgataaactccacctcaccgtctgtggaaacggcaggcatgcccaccatgctgtgttttcctttccacatgcccagcaggttcatcacgttgaaaatgccgtccacgatgcggctgccatactccgggctgatccggtttcccacccccagttccaccactaaagcagggactcccctgctgttcatggcatgggcgagggtggattcatgtacggttgcggtggcgttggtccagaccatatccacattcatcagtctggcatagggaaggagtttttctgcaaaatcttcgctcagacgtacctggggtatttccctcacgaatacatcgcttgcatgaatatccaggcataaatccgcgccctccagatcctccacaatacgggcggcggcctgttccagcagggttccgtcgggggaaccggggaatacgcggttcatatccacatttcccagaggggaggttctttgtaccacatcgattcccagagggttcagcgccggataaatgtctactgtgcctgaaaggaactgcagtccttccttcagtcgtctggccgtctcatagcagatatactgtccctccagctcgtcgccgtggctgccggtgacaattgccagcctggcggcatccgggcgcagccgctctccctggatcctgtttttttctattatcagtttttctcccgccggcagttccatctccacaatacgttcgatcaattttttgcttcctttccttcaccgcttatatttgtccgcagcttacatacaaaacgccccaaggctcatccttgaggcattcgttatcatttaagtaaaatattgatatctgtcacagttataaatcttcatatacaagcccctccatgatataaagaagctctctgtccaccctgctttcggacagtcccatcgtctgggaacacacccgcagcccttccagaacaaacatgatatcctgcgccgtactctccggatcctcacagacgaattccccgttttccacaccggcctcgatcagtcctttgaggatatccacggactccaaaaatttcctgcggagcaggttatcctttttggcgggtttatttgcaaaaaaatactcgtaggcagcaactgttatgctgttttttttaagaagtatttcttttttctgttctttcagaaacacaagaagaatatctgtggcagtggcatcttcaggaatttctcccgaaaaagtatcatccttttccttctgctccgcttccaggacttccctgaaaagctctgccgtactctcaaaataaaggtacaggcctcccctgctgataccgcaggcatccacaatatctttcatggtcacatccttgtagcctttttccacgaaaacctgccttgccgtttctactatgaattgttttttgtgcgctgatttttctcccatagaaagacctctctgaaatccggcttgttcatatcgtatcataaatacacgaaaaaataaagccgaatttttgtgttctctatatacgggattaaggttaataatggcataatttatgaatttttatttaaattttccgctattttctttttttcagaatttttgtgtgctaatatgttcacattaatcagacagggaactatcgctttggctgtaagtgcaaagtcagatttcaggaaagattcaagacttcggaaactggcagcgtttgagatagtaacagaaaaagaatcggggaatctatatgaaatatgtgaaattgtttttcaaaaaactgctgcggtatgtgctgaagccgctttctttccttccggcactgattatgatgtatgtcattttcagtttttccgcacaggacggcgacgtctccggcgcggtaagcagttcggtaagcctgcgcttcgtacaggcctgcgaacaggtgctggacaaggactggaatgatgcgcagatactgcattatgcgcagcggatcgaacattatgtgcgcaaaacagctcatatgacggaatattttcttctggctgtttcggtttcttttccgctgtacgtataccgcctgcggggatggaagcttttgcttgccgcagggttgttctgtgtggcctttgccgggctggatgaatggcaccagtcctttgtccccggccgaaccccttctcccagagatgtgctgattgacagtatcggtatttttgccggcatcgaaatcactcggctcttatgctacatcggacgtaaaacgatcttccgccccctgtctctgggaaacagccggacagaggaggaatatgaggaagattactgttgatttcattcaaaaaggaagtccgggcaaaaccgggcttccttttttgattcttattttgccgccagaatcagacattcaaagggttttaaggtgatgctgcctttcagttccatgccgtcttccaccctcgcataggtgccgggcagctccatctgcgtttccgcttcattgaagttctgcacaaaccacagatcctgtccgccttccctgtgggatacggtgaccccatagggaagccttccggtaaactccgtaccgataccgttttcttccgccagtccggcatacagagccttcagaaaagcctcttccgtttcgcaggccaggtaataggccctgccgcttccatagctcttccttgtcagcgcagggcagcccgcataataatcagactcataagaggccagaacctccgctccttctccgggaatcacatgggaaatttcccgcaggcagcctgttttgtatgactttccttcaaagccgatgctgttgacgcgatgttcgggcgccgcatccatttcttccgtacggatgcccagaagctcctcaagaggatgcctgtccagaatacagagatccgtctcgtccaccacgccgctgaaataagtggccacataacagccgccggcttccacataatccttaaccttcttagcgtaaccctttttatacaggtaattcaaaggagccgccacaaggcggtagccttggagatcacagtcttcatttacaaaatccacatcaatgcccatttcccagaagggcttgaagtgtgccaggatggtatcctgatatgccatgtcctttctggggccctcgatatcctccacagcccaccagttctcccagtcaaaaacaatggcagctttgggcctgttgcaggtagggtataccgtatcagaaatctgctccatgcggctgccgagagcagatacctcccggaatacacgggtattgcttccatttctgtgatccactacggccccgtggaatttttccgagcttcccctgctctttctccactggaagtactgcacactgttgcttccgcaggcgacggcctgaagggaagacaattcatgaagccccggccgtttctgggtatttacagccttccagttgacgatggagggagtgctttccatcatcaggaagggcgcttttttgaggcttctcatcatggaatgccaggccgccgtgcgcacggccacatttacctcatccttctgactgtgccattccggatagttgtcccaggatatgatgctgagttgaggggcaaaacggaaataatccaggggcttgaaatattccatcatattggtggtaacgggcagtacgctgtatttcaggactgctctgatttcctccatgcagaagtcctggatctgatggctcacaaaacgtttccagtccagattcaggccatgcagccggctttccccatttggcacagggctgtggatctgggaccagtccgtataggtatggctccagaaggcagtccaccaggcatggttcagattatccagcgtcttgtatttttccttcagccattcccggaaggcctgctggcattgaggacaatgacaggatgcatcggatccgtttccgccgtattcattggagatgtgccacaggataacgcccggatgatctcccagatgccgggacagctcatgattaatctttttcattttctttctcataatcggagaggtgtaacagaagttatgccttctccccggaagattccgcacgccttccgggctcatctgcctcacttcctcatattttgcggtcatccagttgggcatggcgccggtaggtgtggcaagaatggtataaatgccattttcatataatttgtcaataatcctccgaatccagccgaaatggaattccccctcttcaggttccagcctggcccatgaaaaaatccctaaggaaacacagtttacgcgggcctccttcatgagcctgatatcctcctccagtacctggggactgtccagccactgctccggattataatcccctccatgaagcaggcgcggatatttgttgattacttctctcataagaatcctcccttctacggctccgggccgcataaaaaccaaatctatttacagccttccggcaatcagatcctcaagaacccggctgaccatacagcattcccggtcggcgcatttcttaacatgctcttttgcggtattcatggcataactcaggcctgcctccttcagcatggccatatcattttcactgtcaccaaacgccagcacttcgtccaggaaaaactgctccttcgccgccagcagcctcagggcgcttcctttatccacgcccttattggtaaaatcaagccagccgttcccgccgtccactacgttcagaaaacggtcgtatttttcatggaaccatttttctttatcccccggtattcctttcggccaatagatggaaattttaatcatagggaacttcatatccccgaaatccttaagcacggcaacctggtttttcaccttttcccgcagcatcacaggaaacagaggatccaccggcaccatataggaagcgtccgccccggataccaccacctccgaatcgggcacctcctgcatatccctgacaagggacagcgccagattcctttctatatcattctggtacaggatcgtacctccctgggcgatcagcgccccgttttcacatatataactgatatcctccgctaccggttcgagaagcctccgcagattggcatactgccttccgctggccgcaatgaaggatattcccatggattttaattcccggataagaggaaaatattcctcgtccacatgctgggctccgtccttcagaatggtaccgtcaaaatcactggcaattattcgaatattatctggcattcctgttaacctttctgttttactgtgtgcagacgctttcacttacgcactttctgtctattttactataagagcggggttttccatagatattttttgaaaaatattattaaaatttatatataatattgagtaatggacaggtgttctttattattgccgatatttcacaacaaattttttatgtaaaaagggcttgcttttccccttacggctatgctataatacaattcgccggttcagtaagaaccgtgttgtaggagcatagttcaagggtagaacagtggtctccaaaaccatcgatgtgggttcgattcctactgctcctgttattgaaaagtctgattttgtcaggctttttttgttatcctgaaagatattctgtcatagcagctgcaaaaaaggcatcttcccctttttgcagcaggcccgctcattgcagactgaataaatttccatatcaaaaaagcggttttgatgttcagccaaaaccgccctataatatactgtaatgcagcaacatgattttatttctgccgcactccgtcagccatccataaacacttccctcaaagcctccagatacccatatccatacctgtcatccggttccagatagcttgtttccgtccattcattccagctgtttaccgtaacaaacggcgcctgtcccggatggctgtcggcatattcccgcgccatgacaaatccctttttcacctcttccggcggattgttctttacaattcccggacggaagccgttaaaacggggattattatcccagcctacggaaatatggggataatagggaaggccgtattccttttccatccccttccatatctctttgacatcagccagaatctcatcataatcccggtcaatatcggcaatatgcgcgaactggtaatgagtaactccggaaaatcccaggtatgataccgcatcctcaccctttattgtctttccgttgtccagccccgacaggttatccgtatctccataagctgtcagaagaagataaagatccggaaaaccggccttttttgtttcttcccggaaccattccagggcatccttcgttttttccagcccgcccagacctttcatcagattcgcaagctcatagatctgaaacaccggtttcccgtctatccgataataattggactgtccgaaatactgtgtgatcactctgcggcaggcattttcgaattcctccctgtttacggcccccttccaaatcagacagtcctgctcccaggaaagcctgatatcccaggtataattcacgtcatgattggcccacatgaggtaaaatttcattttatccctgttttttgccttcaggaaaccgtcattcagacaattttccagataaggcattccgtcaaaccagtaccagtcataaatgaatacgttgacgccatgctctgctgccgcttcaatttccatctccatcacagcgggatccgcctcatccacatacccccacagcggctttctgggccactcatgccccggaaatttggccacagcattttttaccgactgccactcccccattccctccggccagaacatgaggctcctcttatcccttccggtatacgccggccacacataagccgccacatcatagtttcccatatgtttctccttcccttctcctgccgccccttttacccagaccctaaatcgaggccgacactccttttccgtaatattatcatatatcttccgtcaggattgcaagtgtcatattttcattttcttcctgatctatgaacacctccgcaatgctatccgaaacataaaaaggcagggccgcccgcccttcatacaaaaagcgtgcagccctgctgtttaaactgttctattttcctgtcgatatcttctgtggtcacatccagcttctgtgccagacactgcttgcagaggaatgacctgcttccccggttcacaaattttttataagcccctatttcattataggtcagatttttcccgcagtccatgcatgcagacattacagatcaaccaccttcgcccggaatacctgacaatcaaaagcttccagctccctggataccgtggcgtttgtcaccttaaaggtttctccgctccatacctccgtcatttccaacgttttaccggtactaaagcccagacccacttcatccagattgaaccttgccgcagccttttcttcgctcatattaaacaaaccgatcgccatatccccattttccagctgtcttgcataaaggaccatatcgtctccggcccaaattccctgcagcttcaccggctgacggcaggcactgtcctggttgatccggatcagctcctcattaccaagaatagcctttgtttccttattcatactgcggatatcacaccctatcatcagcggagaaccaagcagcgcccagatagagaaatgtgtcttgtactgcgtatcactgcagcccttcagccccacattcccttttccgtacatacctacaatcagcatgtccatatcattaaagcatcccaccccattatagggatgcagcttctcctgctgctttaccagatccttcaccgactcccaggtatcaaaaatatcccccgtggaacgccacatagatgctgccgatgtcttgatccattcctgagtctgatccgccccccaggaacaggcgctgaacagaatatctcttccgcagttttccagagccagccccatccttctgtacagatactgtccatggataataggactatgatagcaataatcatatttcaggaaatccactccccactccgcaaaggtccgggcatctgtaaattcatgctcaaagctccccggatacccggcacacgtcaggtttcccgcacaggaatacataccaaatttcagtcccttactgtgaacatagtcagccacagccttcataccatgaggaaacttcaccggatccggcacaagccgctgattcccatcccgctccttcaatgaccagcagtcatcaataaccagatactcataccctttttccaatagcccggtatttaccatagcgtccgccgtttcaaatatcagctcctcattaatattttccccaaacgtattccaggaattccagcccataggcggtgttaattttaccatactcttgacctccgtatctttattaagtaagcttattataaaatgtatttttataacattaccattcaatatcgttgcaaaaacatgtacttttcgttcattttatgaaagtaagtttataatagaacagttatatactacgtaaccttaactgtcttgctgaaccggatgccctgcggctttgccgggctttttccgggcagacggcggctctgtaaggattcctgtaagggccgtataaacacgccggtccttaggttgcgtcctctgcaaccttagtaccgctgcgtgtttatccgagcggaagcgtgccctgtaaggaaccttacagagccgccgcctgcccggaaaaagcccggcaaagccgcagggcatccggttcagcaagacagtgcccccctcacaacaaaaaggagctcatatgaaaaaagaattttattccgaacacacccttctgctcaccaactgcggcagagaagactgctccgaccttcattcctgggggccgggaatccgtccctgctacattatccattacgtgataaaaggcgctggctggctggaatacgggaaaaaacgtttctatatccaggcaggccagagctttctcctatatccttataccgtcctgcgctattaccccgatccggaacagccctgggagtatacctgggtggatttcatgggcgaaaatgcgcccgaactgctttccaataccgggttttctcccgcctgccccgtatccccggccatcagcccgcagcagatcctgccgctttacgaacgcctctgcagcctggatatcctctatcacaacaaaggagaggcctgcggccttcttatggcgcttttaggcctttatgcggacagctttccgggttcctccgccctgaattcccacagggaggataaccgcctctccaccgccatcctgctcatccagacacactgccacaaaccggaattcaatgtggaagccctctgcgaaagcatgcacatcaaccgcgtcactctttaccgcctgttccgggaagccctgtatatctctcccaacacctatatctcccgctaccgtctggaacaggcccgcagtctcctggaaatgggtttttccgtcaaaaatacggccttttcctgcggttattccgatcctttctatttttccagggccttcaaagcccgttacggaacctctcccgcttccttcaagcgaaaagataatggaacacatctgtagaaaaacatttcaaaaaccttcccaatctatttgactataaattggtgatgcattacaatagatttaccaatttatggaaattaattacaatattacagttcatacaaagacagaaacttaacattcgacagcaatgcagttaccggaaccgggtatttcaatatccgtgccccggtaaaagggggagcttatatgtcatggtatgccggtactttttactgtgggcatgaaggctacgttaacatcatcggccctgccagcaacagggaaaaaatgaaggagtataaattttcaggactatgtcctgcatgctgtaaagcggaactcataagaagccggaatgaaaaaaatacggctgcccgcaaagcagcgtcccggatggagcttccgccattggaagggacaaggaaacaggtcgtgtgggcggaaacactgcgggtggaagccctgacgcgtctgcagacctttatcgatacgccgggcaatatccatctgatcattctccggctgaattacgaagcgctgactcccctggagctgacggaagaaaatcttccgccgatgcttcaggaaatcgtgcagtatctcatacatgagaaagtaaaagccgcctactggatcaataaccgttttaaccgggagctgtgcaatctggaacagctcattccggaatatctggaatggtgcaaatggtatcggcccgaacagacggtatccgaatccgattttatacggagtgattctgtcctttcgccaaaaaatccgcaatttccgggtattgtggaaatcaaaggcaatgatgaagaaatatcagctttttatgaaaaaaatgacaggttccgcgaaattatcaggcagatggactacgaatggaatggccgctgctggttccgtaggcttaccccttaccggggctccttccgggatcgtgccgcagagctgggaaatgtactgttaaaaaatggttttaccgtatccataacagataaagaggcgcgggaaggcgcggtgaacggcgatttcagtcccgagcataagcgctggataaccaaaagcaaaaaagggctcttcttttttattcctctttcttcttccattccacgggaagttgtcctgaatctgaaaaagatacctactgctgcctatcattcaggcggcatattcctggaaccttcccattatgaggaactggaggattttgcggaaatgtatggcttccgttttgaccgggaagccggggaactgcttcatgcctatcgggataccctgcagcaggttcctcatgtatcgcctgccgctccgcagccctccgaagaaatcaataacctgcacaaaatactggaatcatccggtgccatcctggatgatctggtggataacgactgactatgcaattacataataaacttctggattaccaggagaaggctgtagaaaaattaaaaaaagtaaaggtgggagctctgtttatggagcagggaaccggaaaaaccatcacagccctggagctgtgccgcctgcgtctggaggcgggaaagataagccatatcctgtggctgtgcccctgctccaccaagcagaatcttaaggacgagctgatcaagcaggctcccagggaaattctggaacgcaccacgatctgcggcatagaaaccctgtcccgcagtatacatgccaacagctacctgcgcctgctgaccgaacaggagcattgctacctggtggtggatgaaagcctgctgatcaagaatccctacgcttaccggacgcagaatattgattatctttcctcacactgtgattataagctgatactcaacggtatgccgatttcaaagaaccaggccgatttatacgcccagttccacatccttgactggaggattctgggttataagacctactggtcctttgccgccaaccatatagaatttgatccggagattccccagaaaatcatccggtgcctgaatacagattatcttgccaggaagatttcaccctataccgtgcaggtgaccaaaaaggactgccttgtccttcctgacaaaagctattccgtaaactatttttccctcacccggaagcagaacgaacattacaatcaggtggccgacgtccttctttttcacctgaacgagctgcatccggagagcatctaccggctttttgccggactgcaggcggttaccagcgggttccgggttcttttccaaaggagtgataccgggtatgagcatatagtaacgcagccgtttttcgaaaaccctgcggacaatccccggctgcaaaggctcctgtccgtcattgacaaccggagtaaatacatcattttctgcaactatacctatgaaattgacgtattatgccgtattttagccgtcaaatacggagaagaacagattgcccgctttgacggttccatccccatgaaaaaaaggatgcagaatctggaaacctttaaaacaagggccaatttcctcattgccaaccgtgactgcgccggctacagtctgaatctgcagttctgccacaatattatttatttctccaacagctgggacctggccacccgcctgcagagcgaggaccggatacaccggatcggccaggaaaaggatatccatatccgggatatctgtgcctacaatacgctggatgaaaggatcctgggctgcctgtaccgtaaggaaaagctgctggaggctttccgtaatgacatcaaaaatatggaaaataaaaaccacattgcggaatggatttattgtcagaagcagaacagagggctgatggattgtgatgatttggaggaagctcgaaatgcctaaaatttactcagataaaaatgtatatgaggctgccatggaacggtatgaaaccattttccggcattttgaccatatttatttttccgtttccgggggaaaggacagctccattatgctgcagcttgcagcccaggccgccagacggctggggaaaaagctgtcggtcctctacattgatttggaagcccagtatcaggccaccattacccatgtggaggagctgatccaatgtacgagggatgtgaccgagcgctggtattgggtggcgctgccgctgtccctcagaaacgccgcctccgccatctgcccgaagtggatctgctgggataaaaaggatcgggacaagtgggtgcgccctcttcccgaccgggacgatgtctgcctgataacggaagatcattaccccaaagaatggacctggtttcggcgggggatggaatttgaggaattcatcctctattttgccaaatggttttccgtcagccgcggagggccggctgcggccggcatcggcatccgttcagatgaaagcctgaaccgctttcgcaccataatcagcaataccaaggaacggtatctcgactatccctggaccacccggatcaaaatccatgacaagcccacggactgctggaacttttatcccatctacgattggtcggccgccgatgactggaccgccgttgcaaaatttgatttgaaatttaattacatatatgagctcatgtataaaaacggcgtctccatcagtgaacaacgcctctgccagccctatggcgacgaccagcgcaaaggccttgaccagttccgctatctggaaccggaaacctgggaaaaggtcctgcaccgcgtggaaggagtcaatttcggcaatatttactgccggaccagcctcctaggcaatatccgttccgaaaaaccggattccatgtcctgggaacaatatgcggtttttcttctggaaagcctgggactgtatgcgccggaggtacgggatcattattatacaaaaataaaaaaattctttgcctggtgggaaaaggaagcaggaatcaccccatcctccatgcctgatgacaaatgggatatccagggtttccgccgcgccccctattggaagcgcatcgccagggcaatcgaaaaaaatgacttctggatgtccggcttaagcttcagcgaaacaaaaggagacgtaaagagactgtttgaactgaagaaaaaatatgccgggattatccggcgggatatccagtccacaaacaaacagctgcgcgacgctgccgggaggattgaggatgaacttacaaaagaaagagtataacgagggttatgacagaaccgaattctattccatcatgggaaaattttttgcggaaaagaaataccgggatgaaatgccttatctgattaataccgaagaaaaggaatggcggcttttttatgaggaaggagtgctcgccggcttctacggccatgaggaaaagaaagagcttaccatagtatcgggcgtttatgtcattcatgaataccggcactccgaggtatgcgccttcatggtggatgacatgctcctctcctttccctctatccgtatgaccacctccaacccccgccttcttacagtcctgcgaaggaatgacttccgccagctgtcccggaggggctgctacctgactatggaacgcgtcaccccctgccaggagaatgtcacaattaccggacagcgatccggcaccatcataaacttggctgaagacagcacacagctgaggatacaaaaggagccagtatggacatcaacaacctgataaatgaaatacagcaatacatttcttcaatcgaagatttagacgaaaaggtggacgccatcaaccggatacgtgacggcatctcccaggtcagccctttccgggaggagcctacggactgcgtactctgggtaaaacaggaagccgtacacgcaaatgaatacaatcccaaccggattccttccccggaaatgcagcttctgcataccagcatccgggaggatggctacaccatgcccatcgtcacctacgatatgcgcaacggcgcccgggagattgtggacggctttcaccgcaaccgcattgccagggaataccctgacatccagcaccgtatccagggctatctgcccgtaaccaccttaaataagcctctggaccagagaattgccgctaccatccggcataaccgcgccagagggacccatggaatccggccaatgagcgccatcatcatggatctcacccgctccggctggtccgatgaaaaaatatgttcccagctgggaatggagctggatgaggttcttcggctgaaacagataacaggactgaaggaagcctttatgaaccatgaattcagccgttcctgggaggaatttgagaaaaaatattatgagacctgagggtgagcataaaaaatgacgcctgcagttcaactgcagacgccattctgttacactgtatactcttactccgttacagagaactgatccttgcctacgccgcacaaagggcatacccaatcatctccgagagcttcaaatgcggttccgggttcaattccgttatccggatctcccaattcgggatcataaatataaccgcaaacgtcacaaacatatttactcattctaatcacctgttcctttctcagttaaattttaaaatcacaatatgtagtattataacaaaaagatatatatattacaatccatccgtaaaaatctgttacaattcagccggcaaagctattacctcccaacaatatgtaatcgtgattattccatgcaaatttttgaaaatttcctttcgtactcaaattgacaaccgtatcccgaacatactcaaaatcatttaccagaacacaggatcttttctaaaacagattagatactatattactttcaaaaataggttctaaacaactaacagcagcaaaattgaaaaataacataaatggaaatatcgcataattttgtaatacatcaattattcactggcagaattatcttcattaatatacatatcccataagtacttgaattgtccttcttccatgctcaattcatcaaatgttccttcttgtaccacttttccttctttaaaaacatatatatagtcaaacatttttgctaagtgtaacctatgcaaaacactaacaatacacttatcgccactaccttggaatatattggtatatatttgcatctctgtagcagagtcaaggctccccgtcggctcatctaataaaacaagactgctatttttcatagcaaaaattcccctggtcaatgccagcctttgtttttctccaccagaaagatttacacctttttcttgtatgtttgtttcaagtccatttggcagacgtctaaggacttcttcgaaacctgcaaggtgaattgcttgatatatttcttcctcttctacctcaatgcccattgtaatattataccttatagtattttcaaaaatttcaggctcttgcggtattaaagttgcaataccttccagcgcagaaacagacagtttttccttcccatcttttatggctactccatccttattatcatagatacccctgagtaatttcaaaacagtactttttcctgctccactttcacctatgaaagcaattttcttcttcctttccaacatgatgcgtatctcattaagattgaaattccccttttggtaactgaaacgctttaataatacctctaaattcttccaatctaatatatctgtagattcagtttctttgtatactcctttttcttctaaaatataagtaatggattcgaaatcagttctccaatggattacagattcataatcccccgcataaaaatcaaatgttgacataaaagtccctaaatagctaaaaagtatagtgacggaaccaaccataatcatattttcatttttatttgtcacaaaaatatagtaaaaaataagtccaacattcaacagaacagtaattaatgcattaaggaaacatttcacctgtgttatcttatgttcatttactaaatgaggaaatacccttcctatcctattttcaatatctttctcagccgctttaccgagtctaagaacaataattgtagtaatattacctatatagtcataaagtgctgacgcaacattatgccaacaatcattataggccttatattccggcacagatttggcatataatatcttggtgacccttaccaaaattattccagctattatcgcaactataacaattacaggagataatgtagataacaccacaagaggtacaataaaattcaaaactacacttatatacatactttgagactcactaaaactttgcaatgcatttgctgccctattcacccgatctataacatttccagaatgattctctgcatgccattctaatggcagactctgaagatgatcatacatcgaacaaataaatcttttcttgttacgaaatgccacccatctttcaaaatatcgtgcacttctatggcaaatttcaaaaatacagaaacatccaaaataaacagctaaccatttcagtacagtattgaataaatttccattatttaattgtaacgcattaactattcgagaaaacgcataaggctgtcccagcattccaagcatagataaaatgtgcaacaccatatacaaaactactctccaatgatcagattttgaatatttccataacttttttatcataaaaatataatccataattaacctcacataatattcataatttatttacatatctccaatagtattaactaatgaactaaatatcccaaaagattacataatccatggatacttttgaccagttctttttataattggcagattttaaagataacagacaaatgccctaatatttcatatctttataaagcatctcccctgcgcagcccttgtccccccaataccaccgcggagttgtatacactcacttcttaagatattagcgcttataccatttcgcttgggtttgataaagctttgcatattctccacctgcattaaggagctcttggtgcgtcccgtcctctttgattttccctttttcaaatacaatgatacgatccgctaaagacgcggcgcttatcctatgtgtaaccataataaccgtcttattctctgccattcgcatatatttagtcagtatttcagactctgccagcggatctaaatttcctgttggctcatccaaaatgataaaatcgcgattccgataacagcatcgtgctatcgcaagtttctgccattcccctcctgataaatcagttcccccaatttcttttcctaatatttcactgccgtcaaagcaattaagtccggcaaatgcaagcgactccttaatatcatcttcattgcgtttctttgatgaatcaccaatatatacgttgtctgaaacggaaaatgtctgatacttagccgtctcctggcttactgagcctgcagaggcataacggctctgaggttcagctttatcggtatcgagcccattaattttcagcttaccgccggatggctgaacaataccgctgatcagcttaacaaacgttgtttttcccgcaccattttcgccaaccagcgcaaccttttctcccttatgtatcgttatgttgatatggctcagcacatatttatctgttaaaggataacgataagatacatcttcaaaactcacttcacctattccctcaaccaaaattccttccctggtttcttccggtaaatcaatcagatcaaaaaacatcgccgcttcattctttttagacataaaggctgccagcgaagtaaagaatacacttgtatcattaatcagggtatttattaatgtcattacagcgctcagtgcgcccagggaaatataccctttggtcatcattacaatggccataatacttcccgccacgctggcgctgcccgttatcacattactaaatgtatccagacacatttttttcagatagcttttgttttctctgatcgtatattcatctattctggttttccatttttcatagaaaaaatcgaacagcgtcattactttgatttcctttacagcgcttcccaacattagtccctgaaaataatcagcttcccgcttcagctttgcattatctttaataaacaaaaactgcagcttatttcctatatatgtagtatacaatgtcggaattggggccgctatcagaatcagacataaccacggattaataatatataatgatgcagcaatcgatattacggatatcagttttgccagcataatatagcttggtgtcataacactgccgttcaggcctttccacccatcctccacaaatccgaaaactcgtgaagttaaatcgtttattttggggatttcgttatactccgcgcttatactgcctaatttcctgtaaatacgtgagtttaaagactcctgaaaacgattggcctgtaccacatccaatcgctcgatcagctcctggctataaatataccggtttaataaatcagccaaaaaatttatgacataatacaaaaaagccaatagtataaccgaggaaatattactgccatttatgtaattgtttgcactatccacatacctcccccaaataaatgcaagtacaggacgtaacagagaaagcaaaattgacagtcccataaaaataagacacattttgggtgcagaagtgaaaacatatttccataattttattaaatattggaaggccggcttgttttcttttaacacaacctcttctgtctcagccgttttatctttccattcattcattacatgcgctctcctgttgataccatttcttctggctctcaaacatatttgcataaattccatttctgcttatcaggctttcatgactaccgctttctgcaattctgccgtctgaaaggacaaatatacgatcagtaatcattgttgaggccaagcgatgggtgataaaaattgtagtcttctcttcagacatttccgcaaactcattatacagactgctttccgcaattggatcaagctgacttgtgggttcatccagtataagtaccggtttatctcccataaaggcccgcgctatggctatcctctgccattgacctccggaaatatccacaccaccgtcaaaatccctgcccaacagggtactgctgccctcggcaagcccctctataaactgctctgctttcgccttacgaacggcctcctgataacgttcttttgaggcattatctatatctcctatgattacattttctttggcagtgatactataacgaataaaatcctgaaaaacagttccaaatatatggcctctggactgacaggaataactcaaaagagagtttccattaattaatatttctccactatccggggtaaataatccgagaagcagcttaatcatcgtcgattttccctcaccattttcaccaacaacggataccttttcccctgcctcgattttaaacgacagtccttttaagatatcctgttccgtattgggataccggaaccatacatccttaaattcaatggatactttttcaggtacatcctggattcctccctgttcttcctcagacagtgaaaaatacttatcataataataaaaaaaatttatatgatagccacttgcggaaaacagtacagtacttccttccaatgaatgatagatgcttccaaacattaacagtgaaagtgaaataaataaacctacattcacttctccctgaataaatagcatgagcagcaacagaatatttatgattggtgcaaattttgttatattatccgcagtaaaattttgttttaaatgcttcagataaaatttttcatattccttatttcgcccatgcagccgcttcttatatatatcaatcagataatcagtcgcctgaaataatttattttcacgcaaatactgccttttctgaagcattcctccgagtatagtatagctatgctcacggttccaataggtttcaagctcatcataaatattataattatgtttcattatccaccatgactcaagaatgaaaggtaaaagcactgtcagcaaaagccaccaacgtacactcgccaaatatgacagagaacctatacttgcaataatggccgacaatgttctgactacatatagaggaaacatatgccttgcagaattttcagcacgattataggctttatcaataatttccacagactgctcattttcaaaatgctcatacttcattttcttaattttctgtaacatctttcctcttaatgcggttcttaaaatcaaaaccgatcttgattccacataaccataaaggaatatactgctaagaaccgggggcaaaatttccagaaagaaaaacaaaacaagaaacggaatatattgcttaaatgccaactcacccatagcaacagaaagaccatcattaaaaatatgtgaattcgtatataccgataagggtgtgatgagtcccaataaaattgcagtgataaaagtcaaaataaccataatgggtgcttctttaaaaattatacccaacaactctccatatgcatgcaaaagcctttttgcattttttttcataacccctccaaaataaaatactaatagttataaacacggatccatatataaaaatacacattataagtataatgtataattgcattttgttcctgtaatataactaattctttttaacaatcagcatattacatatatctaagagcggcaaaggaacaccatcacatatacaataaatattatatgtaggatcacattatccatttataattaggaatatacctgtattacccaataactaattaaataaaaaggattgctcgattttgtctgtataatatgacaataatatccgcagaacatatatatttctcgcataattacagcaatcattaagcaagtcaatcctcttccctgtttaaaaattagcaagaagataattctgctagatctctcagcccttcatgaccatcaacggaaacttgtgtgagtttaaaagcagtaataatcctccaaagagagcatgaaccttaaaaccataatatgtttcctttttagaaggatatctttcataatcgcccccttaaccacggaagtcatggcaataatatgccttcctaaacttgcagactggaagaagaaagctgtcgctcaccaagaaacggctgaccggaacgagaaaaggttttgtaattctttttctcaaaaaaaacccatgcattttctaaatcaatttccagcagtttgccacaaacgctaagggtgataatctccggatccataagcctggcctaccggacattgcgtctttgtgaaacagaggatgggtaaactgtttatacaaatcatcaataattttgtaggtgagtaaaataacatcttcagagggtgatataaccgggttgagacttcaacatataaatgcctcctttcgttatttgtaatgtcctacaaataggatagaatatttatataataatttttattttttcaactagcacaacgagttaaattattataatatatttcaacaatactttataataaattccttaacgtataaaatttcgtcctgaatgccaactttattctctgaagaaaatctttctgacaaataagttagagaatccatttattcaaaaatattatggtaacctgatccccaatagttgaaaaatgttattgcaaaggaaagagcatatgtcctgaaagtgctgagtctaaagtggttaccacagatgtatctgatttgtgaatatttatgcttgatgctttcaggaagaataagcagtctgtaactccttcacgaaagaacactgactcaatatctcacctccctttctctatttaaatttatatatgattatgatataattaccgaattatagtggttgttttttctcttaactgtgttcacattatttatgttatacagatgtagatggaaaaaggagtattttgatgagtttctcaatgtttttaacaaatgttattgcaattatattaatgtcatatactataaatactcttttgcctcaagtccacggtaagtttactgtgcctattttatatctgtatattatatttgtaggtgcctttgcaggaaaatttatcggcttttattccactcctttcttcctgcttggcatacttataattttatatatttccgctggtccttttcgactctggaacatgctattatcccttatcgcctggatgtggaatgttctctcaagttatattggatcctttatcttcagcactcttggatactcttatacttatacacagctttcaaattaccagccttggattttacttgttattacaattactttttcctgcatacctgcttacttcgtcggtaaatggcttcgtttaaaactaactgataatcctgatttaataccgcatcccatgctttctttattattttgggaagtagttatatgtacctctatcttcctgttaaatattgtttggggaagcatcatagggtttcccgcttccatccttatattcagcttttttttattcatggcacttgcaattgcaaatcttcttatttacattaatatgtaccgtacagctcaagagaatcagcgcctggcattacatgcacaggcgcagcaatctttgtcagaatatacacagaaattggaaaagaattaccgggaaatgcgacgctttcgacatgattacatgaatatgctcggcactctgcgtggctatatcctcgaacgggattgggataaacttgagatgtattttgacacaaaaataatgaataacagcggtttactaaaccgcgaagataccttgctcggaaaactcagcaatatgaaggtacttgaaatcaaaggaattctttatacgaaaattgtagaagcattcagccatggtatctgtgtgttttttgaaatggccgatgaaatatcctatattgatgcagaccttttatcactttcacggctactcggaatctatcttgataatgccttggaagcggccatggaaagtgaggccagagaactccatcttgtcatttataagaaaaacaacagtatttttattcatattgaaaatagtacgccgctgctgcaagcgccgctttcacagctatctgaagaaggctttaccaataaagtaaaccatagtggcatcggtcttttctcagcccaattaattattaaaaattgccctaatctatatgtttctaccgaatatgcagacaatacatttaaacaaataattgtgattcaaaatagggagatacaagaatgattcctatttatttatgcgaagataaccaaaaagaactccaatttttaagaaagactcttgaaaattatatcttaatggaatctctggattttcaagtggtttactcagctacgtctccatatcagttgttggataaactttcaggaaacgtaaatggtgctgtttattttcttgatattgatctgaattcagaaatggatggtatcgatctggcggctaaactccgccaaatggattcatgcgcttatttaatttttactactactcatgaagaaatggcaatggagactttccgccataaagtcgaagcacttgactatttactaaaggattcccccaattatatagctgatgttttgctatgcctccagcatattgttaaggaagttcgcaaaccgcacttaaataaagagttccgccttcactttcatattcctgatcaagaactatatttttatccgaaggaaatcctgtatgtagaagctatcgaatcccactgtatcaagctttatacaaaaactgggatttatatttgccggcaaacacttcgtgaaacagcaaatatgtgtcctggcttcttattgtgtcaccgttccttccttataaatccagagcatattcgtgcattgcaaaaaagttcttgtcaaattgtcctggatgatggttcctactgcccttgctcctttcggcaaatccgaaaactgcagcaatatcttgataaccaggcaaaatgatatcattcaatgtgaacgattcataatggtgttggcaaactcacgatacatctaagtgccatgtacgatatctttttgaaaaggtacaaattgatattttcttaaataataattagtaaattctttcgttttacttcacagaaacttcaatcgtataacacaaaaaggtcacaattataaggtatcctataatcacagaaagccaataacgctttttcaatatagatactctttttcataactcaagccagtaccccatgggtactggcttcctccctttttacagcctttttatttttttcttactgcggattccatttccagtccggtgtcataatccagctgtctgggttcatattcctcattttccctctgtctggtcatatggcggctgtcccagtcacgctccattctgtgccatggccgatcctcccaatgatacgaacggaagggatcccttgtccggtacatctgatcaatcagggcttcatgaagcttattgcggacctggctcagcctttcctcatgaatcagattcaccatttcatccggatcctcctgcaggtcatacatctcatccgtatccagcagattgataaccagcttatacctgccgtcaaaaatacagcgcatgggctggaaggatccaaacccatcatgatccacttcatatcttccatactccacaaaaatatggtcattcacacgcacgctgccgtctgccagctccggatacaggctttttccttcaaaggctttcgggatatcaatccccatcatctcaaagacagccggagccaggttgatatgggaaacaggattctcatccaccctgcttccaaatcctttgatcaaaagagggatccgcgcattctcttcataaggcgccgggccttttccggtcagggaatgggaaaacagcatgtcgccgtgatccgacgtataaataatcactgcatccggcgcatatttttccgccgcttccagcacccttccgatttcataatccacatatgtattacagccgaaaaactccttatgggaagccctgaactccggatcctccgtcagatgacggaatggcctggcccacagtctctggaattccggcttgtcttccagggtatcatcaaaattcccgggacggggcagcttataatccgcatacatatccacatatttcttcggacacagatatggcccgtgaggctcatcaaaagatgccacacagaagaaatcctcatcgttataatttttcaggaaatctatcgccctgtccgccactctgtggccgaaggtaaattcctctttaatatcatacttttcaatactgtccgtcctcctggatatcactctttcctccggagtaagctcctccaggtagtttctcatgtcataccagtaatctgcatcccagccctccggacatctgcctaggccgaaataatcgcctccgtccagatgccatttgccaatataggccgtatgtaccccatgatcggacagacgctttccgatactctgcacattcccggaaacacccatggaattagaccatgacgcgcaggaatgaggataacagcctaaaaagatacccgccctggccggctggcacagaggctgtgtggtatacgccttatcaaaacggatgccctgttccgccagcctgtccaaattcggtgtatgcatgtccggattaccatagcagccaagcatatccgcgcgctgggaatcggtcatcaggaataaaacttttcttttgctcattactggcctccctgtttttcatatatgccgtgatggttttccgcagtttttcctttattgcatatcattcatacgaagcacggcttaaataaatactatcacaaagcgccatacaggagcaagacggcaatatgaccaaatgcctgacagacagataaaaagacgttacgttttaccctctacgagtgcacacagtaacgcctttatctctatctgatatatctttttaattcttcataaaatttttctctggttccggctaaaataattaccaccgtttgaccagctgattcgtatattctagtcatcctccgaagaaaaaagtctgtctatggggatacaaaagccatcagcagcaatttcatctgcctctgcgatcagactttccactgcaggacgaatcttcttacttttctccctgaatttactcagtaattccggtccgctatacccttcttctataagttcttccagaatctgttctgcaaattccccctgcatttccttcacaggccgtatgaaaataccatcgtccctgaggatacattccgcttccctgccaaaccccagcaattcgtaatatctctgagggattgtgacctgacgcttggatgatatacttattattttccgttcaaccctgttctctgctgccataataatcccttccgaacccagttctttgtttctttgtttctttgtttctttgtttctttgtttctttgtttctttacttattataacagcagagaatcattcagtcaatcccatcacttaatatcaaatacacttctgaccatcagcttatccgtatttccctccagcacacgaacccgctttactccggcgttcatatcaaagaagttatcggacagcaccagattatcctcttcattccgtatttccacgctcttggcataggcctgcgcctttacggttatcacatccccttctgcctcacagctcaattgtggatccatataagcaaaatacttgggataagagaagttaaccgttccctccgaaaggatctcgccgtccatttccatttcatagctcacgtagttggtacgaagctgtgcttcagggaataggattttatccagccagacgctggtgagcgccggaaccataaggctttcctctccgctcctgacgatttgtgcatcaggagtccgcagcgcccagcgaacggtcacctgcgcatctttcatagtttcattcgccacattgaggcggatggatttttcaaattcaaaatgttcccggttcatgttggcttccgcgctcatcattccctgttcctcacaggaaagaaggagcggggcgaagaaacgctttgcataataatgcagcgccttcagcctgccttcataatctatactcgaccaggataccaccggccagcagtcattgagctgccagtatatggctcccatgcagcggccgcggctgcgccggaaatgctccaccccataacggatggcatccgcctgcagcagctgggaggcataaatgaaggtgtcaaaaccggaaggatatttataagtctgctgcatgtaccccataattttaccgttggcgctgtactggcgctgatgcttctcgcaaatataggaaaaggcattataatcctccggatcatcggtaaaggtttctatcgtcttcagggacgggaacgcctggaagccaaactcggaggcataccggaagaagtacttcctgtattctgaaaatggcttgtttccgtgccataccgcccaataatgcacatctccccggttgggatcattgggttcatccaggcagccgcctgaagaagggcttgccggccagtagaaggtctggggatcataggtatggacgatctccgggataatccgttcaaacatcaggaaataatcccttacctcgctcgccttggtgagccagctgttgcgctcaaacacgaactgctccatctcgttgttgccgcaccataatcccagggacgcatggtggcgtatgcgtttcacattttcaatgaattcctgtctgatattggcttcaaaagcaggagtcagttcgtataccgcacaggcaaacatgaaatcctgccagaccataagacccagctcatcacagatatcataaaaccagtcgctgggataatagccgcctccccatacacggatcgcgttgaaattggcaaaccttgccttttccagaagcttccttgtagtctccggcgtcactctgcccagaagattgtcctccggaatataatccgctcccatggcaaaaaccgccgcgccgttcacttcatgggcaaagcattctccccattcatccttttccctgcgcatgttcatggtacgcagccctatccgtttttcccagcagtctatttccctgccgtctgaatacagaaccaccttaatggtataaagatcctgtgcgccatagccgttaggccaccaaagcttcggctcttctattacgatttctgtgggagaatcctcataaacagcctttgtcccgtcaggcgcggtgatttccgcctgataactcatatgctggccgcatccgccgaaaacccttcctccggttacgtccatcagcttcgggacaccgtcggtaatccctgccgtctcttccgtcacctgcagctgcagcgtaaccctgctgacggagcggtttccgagagcggctatcgccctgtcactgtcggcttccggcactctctcatgctgctgtaatatcagcacattatcgatacgccctctgtcaatccccagaagggtgaccgggcggaaaatccctgcatccggcagatgagcgccccagtcccagccgaacatataatgggctttcctgatatgcacaaacccttccagtgtatcgtcatttcccaatgtccggcactcccggaaggcttcccggatatatttattgggagaatgcagtaccaccctcagttcattttccgccggctttaccttttcacggatatcatattcccagatgcgatgcatattgaacgcatctcccagatgttccccgttcaggaatacgtcggcaatggtatccagcccgtcgaaatgcagcaggattctgtccttatccagaatatcctccgggcagtcaaactgcatggtatattcataatcatattccatcagttccagggctttatcctcgttatccttccaaaaaggattctccatcctgccgttagccagcagatctccgtaaacgctgcccggcaccgtggccggcagccattccatttcaccaagacggcgcattttccagcccgtatgtaaggttttctccgtcattctttttcctccttcatccgcagataatccccgtaccagacaataagctcctgtatccggtaaagctcggattctttgctcacactgcggtagatttctttataatgatacagccatttttccagctcctccgccagcttccatgcatccggcatgctgctgtaggtacgtccgtattctcttgctgtcacgaccttacccagttcattaaacagacggacggcatccaccgctgccagatagggcttcacaagcgctcttttgcctacctttaaatgaacgatactgctgtaaaagtccctgctgatttcttccagtctcttattcttctcatccaccccgtccatatctcccaggtgttccgatatataagccttgtgatcctccgtaaattccggaacctctcccagctctttaaaccggatggccgtctcccagtcaaaagccttctgagccgccacagaagcggcgattccgacaaaccgctcttcttcatccccgaattccagcctggaaatctgcctgttgatctcatcaaaagacgggatatttccattccaggaaaaagcggccccgtatatcatgcccacaacaccgaattccggatggttgacatgaaggaaatcaccccagtctgtgttaaggacaccgatggaatggtacttcatcgcatagctgcacatacggcgtatgttctcgtaagaattctcaatgagatacacgaactgattccagccgcaggctcccggacaggaatactgcaccgctccggcgtcatacagccactttgtttcatcttctctctgatatttggcatatccccagttcaggcatatggtttcctccggaagctctttaatcatttccgggaatccgcatataatatccccccagaacatggggcgccttccgttctccaccaggaattcgcacagagccttcacgaaatcaatataaatccgatccacgcccttttcttcggctgccgctctgctcttgcctttccctaaatcaaaggtttcgtccgcgcagatattaaactgtctggaagtaaacagcggcatgaattcccggatttttccctttatgaattccaggctctccggatccgtcacattgatggtatggtgatgcatcctgccccgcagagaaaaaggcatctgatccgcaccttccagctcacataaatgagagtaccccttggagcttaacaccttatacagatgaccgaagcaggacagggagggaaccagttcgattcctctctccaggcagtactgatccagttccataatctcttctgcagtcagcggcgtatcatccctccagatttcactgaaatcccggaacaggaacgtatgctcaatatacagctgcagctggttcattttatagtaagccatacggtcggccatttttttcagaaaagaaagcttgggcacccttcctcttgtgacatcgtgataaaaacctctgttggggatatcaggaccgtcttctatttgtacaaagggcaggaccgcgccgcattgctccaccatctgctgcaaggtctggcagccgtaccagactcccgcttcccctccggtaatccggacattttccgcatccaccgtcagaatataatcttcttttcccatctgcgggcactgctccaaaatcacatcgcccttccggccttcccctcttgtaagagccagggcaaaccccagcttttcttccagcgccttttgtacaagcgccgcctgccgggtgagcccgtccccgcaggagggatccagcacgatatatccctgataagacaggacaaatccgttttgcccttctttcgcttccttaaattcaatttttctgggctgtggtatgaaatacatggctttttctcctcttattcaaatcccttatatttttccgtcagaagctctatcccatattccctgggcgtacccttcagcctttccatataagcctgcagatgtcccctgcagtgctccggtccgccttcacgcataaccgtccacatcggatccgcatcatacgccgaggttttcatcatggcatcattccagtcgagtatcagctttgcaccctttgcgcacagatccggccgttcctgggccagattatgctgctcatggggatccgcctccagatcaaacagcatttcatccggcagcagatgatagccgccgtgtacggtacggatatatacataatgatcaaaccgtgcgctcctctggcacacatgggcgcattgggtcagtatctcataaggcctggaacagtctgtcccttccagaagcgttcctgcataggaaacgccgtcgtaatgatagctgccgaagcgttccgtccccagcagttcctgcacggtaggaagcagatccacattgtcatggaaaccattcacgtgcctgccgccctccacaccgggccattttatgatcatgggtatccggcataccggttcgtccgccatgccatgttcgccgtataccccgaattctcccaggtcctctccgtgatccgcggttataataatcgccaaatcctcatcatagaggcctttttctttcaggtaatccagaatcatgccgatattgtcatccgtataacgcacgccgtcatcatacagatcgatcagatgctttgccgcctcttttgtttccagccttcccggatgcttgggccactgcttaaaggtatcgtcgttccacatattgatttcattggctccgtgagggccgatatggagcagatgctctttgaaaatgtcctctgtaatccagtcgtccggcagcggcgtatcctgaaaccggctctcatagtccgccggcgtacgatacggggtatgaggatcccagtaatgcacatgcagcatccagttatccccctcaccgtttctctccagccagtccagcacatggggagtcaccatttccgccgattcccctcccctgtttcctacattgaagcattcattaaaacctgcattaaaccaccatgcggaatggcgttcggcaaaagaggaaaaggatacggtatggaaaccggctcttctaaactgcatgaacaaaccgttttccgacatatcatccgtgaagctcctgctcgctccctgcagcctcatatccgcggcggttccgccgtgtcccacaatcccgttatggataccgtactgcccggaaatcagggatgcacgtgagggcaggcacggggcattcggacaataatacctgtcaaagcataccccctgctgcgccacgctgtccatcaccggtgtggtatcccttccataaccataacaccccatgtggtctgcccgcagggtgtcaatatcaaacataattacacgcattgtttttctccttttatttttgtgtattctttttctgccttaacaaaaccgcaggcttatattaccgcccctgctcactttctcatccgcatatccgacggtgtggtatgataatacccatgaaaatgctgatagaaataattcatattggaataccccacatccgccgcaatcactgcgatcttttcatcggaattcaggatcctctccctggctacataaagccggtaacacatcaggtattcggaaaatttcattcctgtttccttgataaaaatctggcccagataggtggaattcatccggaatttatccgctatgcttttcagggaaatatgcccgccatattccaccctcaccatcattacgatcttatgtatcagaggggacatggcatcataatccatatccagcacaggatcacagttcttcttttcatcctcctccggtatggttccatgaagcttttccacaatgattttcctgaccacctctaaaagcttctttttctccacgggcttgagcaggtaatccagcgcgccgcagcggatagcctcgcaggcatagctgaattcatcataaccgctcatcatcacataattggaacgcacccccaggttattcaggcagttaatcacctcataccctttatcgtttccaatacagacatccatcagacagatatccggcctccagtcaaggatattggacattacctccagagaactgcgggcggtttctatcctgcccactcccaggcttttccagtccagaagccgtttgattccctccaggatgtttggctcatcatccacaatcaacaacgtgtacatcagtctcctccttgcctgcctgtgtggggatatagacggaaatcctggctcctccctccggattgttcccgatctccattgtaaaatcctccccgtaaaaatactgcagtctcatatatacattccggagcccgatatccgcgtccggatcgtcgcttccttcatgcatattttttcttatcgcttcaagctgctcccttgcaatccccagcccgttatccgtcatgagggctcttacgccgcctccttcagaacgtatttccagaatcagaaggttgaattcgttatttctgtcaaaaccatgggaaaaaaagttttccgccagcggctgcagccagaaccccggggtgcgaacgccctccagatccttttccaactccagctgatacacaaaatttcccgcaaaccgaagtgacatgaggcgcagatataattccagcagatctttttcttccttcatggttatcacatccggacaatggacaattttccggtaaaggctgcccagctgtgtgatggcctccgccgtctcctcatccccgcacaccagcgccttggaacgtatactctccagtgtgttataaagaaaatgagggttaatctgatgcttcagggcacgcatggccgcctcctgctgcttcagcttcatcacatactcggtacggatatacccctccagcttctggctcacatccttcagagcgatggctattcttccatattcatttttatgctccgtatggatttccagatttttagccacggaaaagtcaccgttttccatagctcccagcatctgcatgatataggaaaggaacctggcatcattccggattcccacaaaggataccaggacagcgccccctgccagaatgatcaggacaaaactgatcccgatcagcgccgaccggttcagccgccagagcatcttactgttaatcacacaaatataggaaaaattatattggctggacggaaaaaccgtataaaaaatccgatcgtagccgcttccgaaaaaggctccctgactctcctccaggttttccgccgcccggatccagttccattccttctccatggtataatccgtatgaagaggctttccctcctgcataacggcccaggccccggatgggttcaccccgcggaataaatcatcccgatccacccagaaggtaaggcgtcccagctgacggccgatggaatccggatcacggatttcataagaagcgagtatcatgtccccgaatcccgggattcccagagccgactcttcccgatccagatcaaaagtaacatgcatgtcaccggacactctgtcctgccataccgccttaattccgctctctgaaataaaggtggccccccttatctgcgtccggttgttgataaacagcttcttcatgtcccccggcatataagaaatctgggcggaagtggaacggctgttggcaagcctcttttccagatattcttcctccgatccggcagcaaacagcgccatggcatcctgcatcatggtacggctggcataacagccctcgatatattcattcagctgatccttaatagtgcctattttcctctcaatcacggaaaaggcatcctgggcctcctgccgctgctggcccgcccatatattggtaaaaaatgtggtcacaccgataaagcatatggtacacagaagcaaaatagcaatggttgttcccaggaactttctcctgtaaacctttattttcaggaaagatatgctgttttttctcatagcggactcctttttatgccttactcagccagaatcttccttctgccttcactcccattatacccatatttgtatccgccaacaaggaaaaaccccctgacgtgaacattgggagtccgaagttcacgccaggaggctggtttctaaaggtcaccgcaagtacacgatttcactttatttaaagaactcattaatctgtttctgtgtttcttcaataatggtatcaagaccggaattctttaattcctcaatacatttgggaaccgtggtttccggatccgatgcgcctactaacatatcatatttatatttgtcccaaactgcctggcagttggcaacttcattctggatattggttatatccagtgcaaatccaagacatacagaggaagctgcttcttcattctgtttcttaacctgctcccactgctcgggatctgcgtcttccgtaatggacatgttgaagaatgttccctgtgtataagcagccagcggccagtcgtctctcagcttcttaataacgccgtcgcttacgtattcaaaggtatttccttccacaccataagccagcatatcacggaatttggaatcgctgttaaccagatccagaaccttcagacattcttctttgtatttggagttaacggaaacggcattcatggagccctggatggtttctgtggaatacaaaggtccgaacactttgaatacatcatatttctccacgccgttcagtgtctgccatgtagctgctgcactgggccatccctgtgcggaggagaaaggaagcttcttgggaacttcggtaagaacgttggcatccggattgattatgccgtccatgtaccactgatgcataagcttcaggttttccatgatatcaggctgttccagtgtgcaaactacagttcttgtttcgtcatcaatctttacgcccataggctgaaggcctgcggtaagtccgtcatattcgttaaagaagccattgaacgggctgccctgtgccatctgcagaggataaaaactcttgccttccccttcttttattgcacggtacgggccgtccagatccttcatcgtcttgatggaatccagatcgatattatatttctgtacatactggtcatcaaaataccagaactgggtaacggaggaatccttgtaggtcggaaccgcatatacatttccgccgatttttacgccgttccacagctcttccggaataaagctgtacaaatccggagtgctagactgcaccatatcggttatgttctcgaatgcgcccaggtttacaaacttgctgtaattggtattgttggtaaacatcatatcgaaatattcaccggagttaacgatagtattcatcttctgatcgtaatcgccccagcctgccaccttgatatcaattttcacgcccagcttttccaccagatattcattgatatctgccagacgatccgtataatcgctgggagtggttccgcctaccgtccaccaaatcagtgtggggatatctccgctggccttgtcagttgtgctgctgtctgccgcagattctgccgctgcgccttctgttgcggcggcagcacctcctgtttctcctgccggtgtgcttgcaccgctgtctttggaaccgcatcctgccagcatacccataccgagtacacaggaaagtccaatagccaaaagtcttttaactacattctttttcatagtaacctccttataattttttatatcctccggcaataaattgccggtacgacagcttttcatcacttatatcagcctttcaccgcaccaacggtaagtcctgatataaagtatttctggaaaaaaggatatgcacaggcaatcgggagtacgattactacaacaattgccatacgtgccgcctccttgggcatattggctaccgtatccgccatactcgctcccatggccgccgcattctgagccagcatgttcacattggtcataatggcgttcagcagcgcctgcagggaatacagcctctggtcatcaatatacagcatggactgataccagtcattccaataagcgaagcagaggaacaggccgattgtggcaagcaccggaagggatatgggaagcacaatcttaaaaaatatggtgaactgcctcgccccgtccattttcgccgattcaatcagttcttccggaaccgtagtcttaaaaaaggttctgcatataactacattgaaggatgaaaccgccagaggcaatatgagcgcccataccgaatccttcagatttaaaaactgagaagtgataaaataagtggatacaaggccgccgttgaataccatggggatgaataccaccattgtcaggaacccgttcagcttatagccgggacgggaaagcacataccccatcagcgtggtgagcaggattcccagaacggttcccactatggttacaaaaagggacactcccagggcacggataatcagcgtgctttgctttgccagatattcatagccttcaaaagatacaatcttaggtatcagatgataaccgtattccgtaattgacgcttctgccgaaagggatattgcaatgaccagcagcaccgggataatacaaaccagcgccatcaatacaaacatgacattcagcaggacgttcgccgtattggacactctgttgaaacggtcaaatccatcgggctcatttttctttttcttttttattgtttcagccatcccgcacctccttaaatcatcgcgctgtcgcggtcaaccttacgtaccacggcattggctgtgaggatagtaatacatccggccaccgattgtacaaatgccgctgcagatgccattcccgtcgtggaagatttcaattgcttgaatacaaatacatccagtgtataggaaacattgtacagggaattggaatcacggggtacctgatagaacagtccgaaatcggaatagaaaatacgtcctaccgccatgataaacatcatgatgattacagtcttcataagaggcagcgtcacatatctcatctgctgccatactgtagcgccgtcaattcccgccgcttcataataggtcttgtcaatgcccgttattgttgccagataaaccaccatgctgtagcccaggtttttccacatatacatgaatatcaaaaacggcggccaaagcttcggctccatataccactgatggggatccttcccgaagaactcaagcaggctgttaagcagtcccttatcaaaactcaggaacgcccaaatcaacgcggttacaacaacccaggacaggaaataaggcatgaacatcgctgtctgatatacctttgccattctcttgttatgcagctgccctataagcagcgccatcgcaaccggaaccacaatgttcaatatgataaatgcaatgttatacagaatggtattccgcagaataatccagatatctccggcggaaaacaggaatttaaagttatccaggccgatccagtcactggttataatactgttcaggaatcctccgctgatctggtactttttaaatgcgataataataccgaacataggcagaaaagcaaacaggaaataccagattgtggttggaagcgccagcatggtaagctccgtatcatcacgggtccagcgccttttcttttttatactactttcctttacagccattttaaacctccctttctctttactaaacggcctcagaggtctgaaaaaacgtctgccgtctttccggttatctgtaatctatatacagacccggataaatctctctccgtcagccggcctgccggagagacacagccggaatgcgtacgcttcgttcttctgcttttttccgaccgctttatgactcaattataaactatgcatttcgctatttctatctaacatttcttatatagtagtctaaaaacattatctcaaaagtaaaaaaacgtgattttaaattgtgcatctttcacaaattatacagaataccctcctattttccttatatcacttttgtgtaacattttatatactacatctaacgtttttgctatagacaacccttttttccctatctatactgattataaatacaaacttttcaacagtaaccatgccgccggcctgagagcagccacgagccggaaaaccggaggccggagaacggcggcagctgccgcagcacaaccaatttggaggaggacttgccatgacgcaggataacattctgctaattaccaccgaccaacagcgtttcgacaccatcaacgcctggggaaacaccagtattttcacaccccaccttaattacatggccgcaatgggaaccagcttccgcagctgctatgcctgctgccccatctgcgtcccgtcccggaccaccattatgaccggccgccacggatatgaaagcggcgtggtatccaacgccacccatgaaaccgaaatgcgccgtcagacaaaactgcgccgcaccctgcccgcccttctcaccgacgccggctatcagacctgcgccaaagggaagatgcatttcgaaccggcccgggcctgttatggctttgaacagatgacccttcctttggattacatgcgccaatatgacaggaaatcggaatccgcacgcccgaaggcccacggaatcggtgaatgtgaaatggaaccggttctttccaccgtcgatgtaaaagacagtatcactacctggatcaccgatcaatccattgattttctggaaacaagagacaccacccgccccttcttcctctggaccagctttaccaagccccatccgccttttgacccctgccgggatttctggtctctctacgagaatattcccatgcccgcccctgtctatggggactggtcccgggatttggagaaagcgcctcagggcttcctcgcgggcgcctatgaaaataccaatatgcatctgttcggccccgaacaggttgccgcatcccgcagggcctattatgcctgcatcacccaggttgattatgaactgggccgcctgttcggcgcgctccgggaaaacgatctgttccggaacacctggatcattttcacctcggatcatggggaaatgctgggagatcaccacatgtcccagaaaaatctgttctttgaaggctccgcccatataccgctgtttattgtaccacccgccggaaggggaattccccataaccttaccgttgacaggccggcagagatcgcagatatttacccaaccatcctggaaatggccggcattcctgttccggaagacatcacaggccaaagcctgctgaatccggacgcgcttactgaggatcggatattttacggagacagccttcatacgaatttctgcgtgatgcgccgccaggtcaagcttgtatacaccacctgcggagaccagatgcttctgttccacctgaaggaggatccgatggaacagaccgatctgtccggagatcccgcatggcaggataaaaagcaggagctcattgcccttctgctggaacacgtgaaggaaacggccccccaggttctggaggaacgcacttccccggacggttccacatccctctggtttaaaacgacgcctccgccccgtttccccggagatatgcccggaagatggttcggcttccactaccatgactattccgtggataccttccattaaccttatggctgaaatcccaaaaagccccgcccgtttccacataagggaacaggcggagctttttttatattgataccacttctgtactcggcgccccggcacaggactttctttttccgaactattcagactcagccagcgccgccatgactttatccatccagaaagcattggtcccggcataaagaccttttccgtcccggatttccacacggatatacccttccctgccggtgatctcaaattccgcttccgtgatacattctcctatgggcgccagcttcttatagcagtcacgcccctcctgaatcacaaaaatcttctccaccggcgaggttttcaccacaagcctgttatcccgtatgtaggcttctttgatttcaggccccatggagaaataaaaatctcctttttccaatgcttccatcaccgccgaataatccaggcttcccgccttcaccatgacgaacccgccgaaggaatcacacagcggggaatcaaaaggctccctgttatgattatcatccgtggcaaccgtgaagatccgctgccccgtacgaagcatttcatcataagactggggatggaagccatacagcccgtcatgctcgcagccatggttataaatctccattccccacagccctcttaaatccttataatcctcataattctgcaaagaccagtaaggatggttatagcaggccagaaagccctccgtcttcatcaaatcaatataaccgttaatgtactctatatcattatagcggcgtaagggcatgggaatcttttcttccttttcccttctttccggatatttatcataaaaattaaaatgataaaccttcagggaaggccaggcgtcctcatgaggggaaaactggtcaatattcgcttcatatgccgcaatactcaggaagccttcgtcgttcagctcctcatgcttgcagtatttgttgtgatccgtaaaagcaacaatagaatagccctgccccatatatgcttccttcacctgctccggcgtcagatccccgtcggagaccaccgtatggcagtgcagatttgctttataaaaagttccttctttcggtaacaaataaaatgttcccattcttataccctcctgtctgtgtatccctcacaaacccatttattaagattgaagcctctccttcaacccgtctttaccgtaccacacgaacaccgcagtaatccagaaccagctcacagaacaccgcattcgcccaggaaaaccactcccttgtgaatttggtgggatcatccacatgaaaaccttcatgcatcattcccgtcccgccgtccgtatcacgcatcagctgcagaatacgaagcttctcttctttggaagactccgtcattccctgaacggccagcccgatatgccagatataataaggaggcacatgaggacttccgattcctcctgccgcttttcccttaaaataatatggattcccttcactgagtatgaaacgccgtgtattctccatcacttcccgatccccatcataacccagatattccatcgaaagaagactgggcacgttggcgtcatccatcagaaggaactgcccgtacccatccgtttcataggcataaatccttccataatactcattcttcaccacggccagcgtttcaatggcctccttcacttccttccggaaagcttccgcctccgccgcaagcgcttcatcccccagcacctgatttgctatctccgccagatatcccagcaccaccacagcaaacatattcgaaggaatcagataaccatagacacaggaatcatcactcggccggaatcccgaccaaatcagccccgtccccgacttaaccagagcacccttccctccccgggaaagcgtatccgtaaaataacagttcttacgcacaaaatgatacggcgaccgctcctcatgatgctgttctgtacgccagacctccaggatcctgcgtacccccttcacaaaggtttcatcaaaatgatccgtacgccccgtatttttccataccagataagccagctgaatcggataacacaaagaatccagctcatacttcctctcccatatccacggcagcatatccgtctcatcatgctcccagcagttgccgttagcctcctgattaaaagcattcgcataaggatccagattcacataaaagaactgcttccgaacaagccccaccagcatgtccgcaatctccttatcctctcccgccgccatgagataaggccggatctgcgccacactgtcccgcagccacatagccggtatatccccggtaataatataagtagtcccgtcctcaagccgcttcaccgtagtatccagagtattggtaaaacagtttataaacaactgcaccatcctgggatcctccgggaaagcctcctccaccttcttaatcagcttctgcaacgattcaggcaattttttctccatttgccgcctcctccttttaaatcctgttttcttttctttctgccgcagacataataccacaaaaaaatgccttatcctatatcacaaatctcatattacctactaaaaagaatacttcttaccattccgcaatcaacggcctcgggaaaagccaccatttctcaaaatccagacaatactgggaacaacagatattatgatcctcaggataatcatacgacgtccatgcaaaataactctccacaatctcatccagcagatcagaatccatactctcacaaaattccctgcacttctccacaaatccctccggcttatcctcaatcccctccacagcagcctccagcctccggttacagggaaaaagcaccctcttctcctgcagaatcagacgatacaaagcatacacaatctcactccccgtccgcatcttcatatacccgtccggtttacagcacttccaaaaataattataattcagctccagatcactgaaaaacgaaagcagcttctcctccctctccttctcctgaaaaacaggaatagccgccacaagcccctcaatttccggatccctggaaaaaagcaccctcgacttaacgaacgaattcctcgtaggctcactccccttcaaagccgcctgctccagaaaatccttcgtcatatacttaatatcaaaataaccgccctcataagtacaccccgaaagacactccgccgtccgattctccttcatacactgatcaaaatactcctgcgtaacaatcaccatcgcatccagatccgaatccggccgctccatccccttagccacagatcccccgaaaacaagagcgattacctcctccctcccccggaacatatcctccagtattttcaaagactcttcatgatgctgatacataatcccttctccttacctatccatattatatactttataccgcccgtcccccgggcgccacctacactacccactataaacgatacccaccccacttacaatatctctttaccaattttaaaaatccttaaaaaaatccccctcttttccctcccccataattctcatttccctttttgccccctccacacacaatcccccaggataaatgcatccgtcacaggggcttcgttccctggcgtcatggcggcggcctggcttttgtctccggcccggggcgtttggggatgtggttggggctccatcagaaaaaacggtgatgtttcttaatgttctgttcagccgggagactgccgtccctagcggcatgtctgacgagtctgagcggcgaagcccgctaaggcgaggagttctgccgcgttggcagcctcccggctgaacggaacatttagaaacaccccgtttttgaggctggagccccaaccacatccccaaacgccccgggccggagacaaaagccaggccaccgccatgacaccagggaaccaaagcccctgtgacggatgcatttatccgccctcccccgatcaccctcgcaaaaataaaaacaataattattatcattttctattgacatcttttctcatttatgtataatgaagatgtaaacagcatatgccaattacacaagccggaaatgcgaggtgatgatatgccccggccaactaaggaacggaatatctgctgcatgccaaagtcctctaccttcggacccgtaaaccacagctgcagcgaaaaagaatgcatctgcatgaccattgatgaatatgaatgtatccggctgattgatctgcttggatgcaatcaggaggaatgcgcgaagagaatgtccatcgcacgctccaccgtacagatgatatacaatgaagcccggaaaaaaatggcagattccctcgtaaacggaaaacttcttcatataaaaggcggatccttccggctgtgtgacggaaacggctgctgccccgcgggtgaatgccgcaggaggaagaattgtccccagaaccttcaggagcaggaaaacagaactgcaaaggaatgacatctttttaatacaagatgcatttaaaaataaaaaaccattaattttgcatccggtaaaccggaaagaaaaggagaaaagaatatgagtaaagtaaaattttatatctgcagacattgcggcaacctggtggaaatgattcatgacgcaggagttcctgttatctgctgcggtgagaaaatggaagaactgaaagcaaataccgtagacgccagcgcagaaaagcacgttcctgccgtaaccgttgagggagaactggtgaaggttcaggtaggcagcgccgttcatcccatgctggaagagcatcacattgaatggatttatctggagctggaaaacggcggattccgtaaggatctggttcccggagaagctcccgaagcagccttccataccggcggtgcaaagcctgttgccgtatatgcttactgtaatcttcacggtttgtggaaaaccgaactgtaattttatttccttccaggcctgtccggaaaggaatccaaagctcacaaagcagccgctttgtgagctttccgatcgttataaccggttattccgataccccggccatatgcccgggtatcgcaacaatactaagcacatgtgaaaggaatcaatcaaatgagtgaaaactgcagccataattgctcctcctgcaaggaatcctgcaatgatcgggatcccaaaagccttcttcaggagccccatgaaatgtccagcattaaaaatgtcatcgcggtagtcagcggcaaaggaggcgtgggaaaatccctggtcacctcccttatggcctcctccatgcagaaaaagggatatcataccgccattatggacgccgatattaccggcccctccatccccaaagcattcgggatgcatgaaaaagcctatgccaatgaaatgggactgattcccgtaaaaacccggggagggattgatatcatgtccatcaaccttcttctggataatgatactgatcccgtcctgtggcgcggcccggtaattgccggcgcggtaagccagttctggagcgaggttatctgggacaatgtagactatatgtttgtggacatgcctcccggaaccggggacgttcctttgacggttttccagtccctccccctgaaaggaatcattgtggtaacttctccccaggagctggtatccgttattgtggaaaaagctgtaaaaatggcggagatgatgaatatacctgttcttggcatcgtggaaaatatgtcttattacgaatgtcccgactgccacagcagacacagcatcttcggagaaagccatatcgaagaagtcgccgccaaacacaatatttccgccattgcaaagcttcctgtaaatcctgccattgcggcggcctgcgatttgggtgaaatcgaggcgctggatgccccctggctttcggagctttcttcctccattgaaaaaatgtgtcaatgaatgctgccatagtatccggcagttccaacagataatgcagcaaacagttcaggcagcgagccttgccttgcgggccatccgctgcctgaattaaaaatgaccgcctccataaagagacggtcatttttaatgtataacaataaaaaaagagggggggtgctgcggcagattggggaggggggattggctgtaataagccaatatccgccgcagccggtgaaggttcctggcaagcaggcatacccgcttacaggaatcttccatttccgggttcaaaatattctttcttcccggagtaaaaaggcgctcacaccttctggtataaacgtcctgactattcttccatgttttttatgtctgacaaatcagttatcgaaaaccggcatggaaaccggagatataagctaataacacttaagggggggtgccggcacagccgtagctgtaccggctaattttgtgggttgatgactttcaacttggttttatcatataccaagtttataaacttgtcaacactttttataaatatttttaatttttataaatttcataaattaaatttatatatcgcattttttcagcgattcggagattcaaaaaattccaggctttacgcgctatagcttacggacactggccatttccaccagctctgcattcatttccagacgaatcggaacatcctccatagaacggcttctcatatcaattttcccgttaagcagcatgatcagagtcctccccagcagcctgcggggaacacgcattgtggtaagcgtaggctccattatgctgcagatactgcgcccgtcgaaaccgataaccgatacatcatccggtacggtataccctgcccgcttcaaggccctgtacacgggaattgccagcatatcattctccaccagcagcgctgtgggcggcttcacgccgctcttccataattcctccagatacgcctgggcctcaagtcccgaaccattggttacgatattccattccggacacatcttcacttccagatcctcacaggcataggaaaaacagcggcgcctctccacaagggagctgcaggatgttcccgaagatacatatccgatttcagtatgccctttttccagcagataacggacggccgtatagattccctgacggttattcaccgtaacggagctggccctgatatccggatcgtagcagtccagcatcacatacggaatatccgtcccgtccagttccttcttcagccccgggctcatcatatcggcataaaccaccattcccgcatactgctctttttttatactctcccgaagcctccccgccttctcatcatacatatgtatgatggaaaaatggtatccgagccgcctggcctcccgttccgcgccctcaattaccggcggaaaaaaagcgccctcatccccttcctcctgatgatcggcaagaataatataagcaatatttttggcggataccgcactgccgcccgtttccgcttcctccgcctctttgatcatgtaaccataacccatttcctgaattctggaaaggagcgacccgcgaagctcatcgcttattcccggcttatgattcaggacaagcgacatggttgctgtagatacacccagtaatttagccagttccttggatttaattgccacgattttcccctcttttacaaaatatacgaaaccgttgggaaatgatgaaaaatcatgcctgacaatttcgtataattcgtttataaattttatttataatattattgtaccgtatttttaaatattttcaagcattaacaggtatactaattaacaaactttgaaggctcattttagccatttctgcccattcggccaaaatgtcccaaggtttgccaaaatacgtctgttcagccggtgcaagactgaccgggcagacatgaaaatatatagaaaagagaggaagaaagacatgaaggaagaaaaaagaccttatcatgacggactttcatttcccagcgctaacgttcccggcatcactccggaatccgcctttacggacggatatctgacagcgctccataatatggataataccggatctgcggacagcgtaaatatcgatgaggacgggaaggcctccgatatggatgatcagtccgtaatgtccggtgatggctgtaatccggtaaacagggattcggaaatgaaccgagcccatgatgatgatgcaggatggattttcccgggagtatatcctaattccggaatgcccggcacctcgccgggagcttaccccggaatcattccccccttctactttcccggcgccggagggacacctgatctgtagccttccatcagacgcagaaacgccgccctgtcagcgtaatcgttcctgtctttcagggacggttatgccggccgggcggcgttttatattccatttttatgtaaatgctctgtcttacagcccgcagatttcatcgatttttttcagctcatcctttgtaaaatctattttgtggatgatctgaatattctccgttatctgggaaggcctggatgccccgatcaggacgctggtcacttctccgtccctcaggatccaggataaagccatctgagccaggctttgtcctctttccgccgcaatttcgttcagtgcgcggatttgtcccagtgtttcttccgtcagtgcagattccgtcaggaatcttccgtctctctttatccggctgtcctccgggatcccgtgcagatatttatctgtcagaagcccctgggccagagggctgaaagcgatgattccgcagccattacggactgccgaagccttcaggccgttttcttctatcgtgcggtcaaaaatggaataacggttctgattaatgataaaagggcatttcagttcattaagaatcgccgccgctttttccatggcttcgccggtatagttggatattccggcatagagggccttgccgcttttaacgatactgtcaagtgccagcatggtttcctccagcggcgtttccggatccatcctgtgatgatagaaaatatccacataatccagcttcatcctctgaaggctctcatccaggctggatatcaggtattttctgcttcctccgtccccgtaaggccccggccacatatcataacccgccttagtgctgattaccatctggttccggtaaggacgcatatcactgtccataattcttccgaagttatcttccgcactgccgtaaaccgggccgtaattattagccagatcaaaatgcgtgattccattgtcaaacgcagtgaaaataagctccttcatattgtcgaaattatccttgctgccaaaattatgccaaagtcccagcgaaacggccggaagcttcagaccgctctttccgcagcgaaaatatttcatgctctcatatctgttttcttttgcctgatacatagtttttcctccttaaacctgcggattcccgctgatttcacaatcgttcagtgtaagcattgccatggtataaatctttgcggcatccagaagctttttcaaatccagtccttcatcgggttcatgcgcgcccccgtgtcctttggcaaacagctctgaggcccggtcatcctcacgctccggcatggatccgattccatagccaaaggcattgggaagctttctcgcataagttccgccgcccatcacataaggctttgaatcacttccggtcagttcattaaaaagggaagtcagaagcgcaacctcttttctttccttcgggaaataattgggagcggaattccgtatgagctcccagtgataaccggatgtcctgcagaacccgtcaagcacagcttccatatgttccggatccgcggtaatcgaatagcggatattaaactgcagagccgctttcccttcctgaagcttcaatacggtcccggcacaggtaagccttccggacacctcatcttcataagcgatgccgattctttccccataataatcagaagtagcctcctcaataaaatggagaagcttcctgtcctcttccttcagaagggaggacgcgcataccgcttttgccagctcatgtatggcatttacacttccttccgggaaagcgctgtgccggcttgtgcccctggcggttatccgtatctgcccctcttctttttctgcctgcagagcttcgggcagctgccttagaggctcttcaagctccggcctgtcccgaagcaccagaaccgccctgtccggtataatattgccggcgcttcctccgtacaggtcaattacatcctcactgaaggaatcgtctgcggcagcccagccctccagaattcccttctccccgtaacaaaccgggaatccgcagtcggcgatcatggataaggcgggaaaaggatatctggaaccataatattccagatcagccatcccccgttcctcatcacagccaacaaacagacatatttcatgcttcatatcaagcttcaaatccctgatacaccgcatcacatagagcatggccacagcaggccctttgttatcctgagcccctcttccgatgagatatccatccctcaccacaggatcaaaaggggcataatcccatccttcccccagaggcaccacatccaaatgattccacaatccaatggtattattccagtccttcttttccctgccgatggtacccacatagtattctttattttccgaaaaaaaaccatacttccggcccatggcaagcatttcatccatcgcatcccggcaggcctttccgaacggccctgtttccgcctgcggatccgaaatactgggaatcctcaccagtcttttgatatcctccgccatttcttccctgtgttcctcaaaccactgccccaccttttcataggtatggctgtcatatcctttatccatactgcattccctccgtaaccctttctgatgccattatagtctttttctcccccgctttccatagctgcttacagcaaaaactgtgcagattcaatcatttattgctatttggcagaaaaaacagccggaaagccggctgtcttttctgcttatcgttatctctgccgtcttaccggctgcccttgtcataaatttctcccaaagcgcggggagcacggttatgcttggaaaagaataccagcagaagaagcgtcagcacatagggaaggatcataaccagatcctggtaactgctgggcatttccataatctgtacaatacggtagcccccggaacgggccagaccgaacaggagacaggcccccagggtgggaagtatcttccagtttccgaatatcatcgcggcgatagccagataaccatagcccacataaatattattggaaaaattagcggaaatggaataggcgaagcagatgccgccaaggccggaaagggccccggagaccataactgccaccagacgtacctttcccacttcaattcccgcagcatccacggcatgagggttgtcaccacaggccctcagatgcatgccgaaacgggtcctgtacatgacaaaccaggcgatcagcgccacaacgacgataacgatttcaaagggataaatattggaaaatacggcgcccagcacggggattttggaaatcaccggtacggtaagccggctggataccccgagcacaaatttatccgaagctgctccgaaaaccgcggcattgatctgttttgtcaaaaaagaagtcatcgccatggcgaggatattgataaccacgccgctgataaccatatttgccttgaaccggatacacaacagcgcatgaatgagcgaaaacagcgttccgcctatgacggcgaacagcatggcgatatagaaaggcatgaccgagtttcctgaaaagctgcccgccacaagcacggccgccagcgctcccgtaaacgcgccgaatccctgcaggccctcgatggcaaggttggtaattccgcttttttcactgtaaataccgccgatggccatgataaacaacggtaaggcaaaggacagtccatctatgattaccgtattcatttctccttcctcccttcctcatccttcatacgtgtcagcaggtatctgatgaatgcggagcatgcacagaacaaaaggataatccccgtaataacatcggcaatctccgcctgtatccccgcagcggagctcatataagtacttcccttatccacaacggttatcagcagagaggagaaaataattcccaccggattgttgtttcccagcagggaaaccgctatggcatcaaagccggtgctgctcaataccctgggctgaatggaagcgaaataacccagataataggtaacccctgccaatcctgccaaagcccctgaaataagcatggtcacaacaatattcttacccacattgatccccgcataacgggacgcgctgcgggagaagcccaccgctttcatttcgtaacccatttttgtcctgtccagcaggaatttcaccaggactacggctatcagggcaaggataaatccaagagggatatccattttcaaatctcccaccacggtatccgccagggtgagccgggcagactgtgcaacggcctttgactgcctggaaacaggatccacataaaatgtattgatacagaagctgcatacatactggatgatataattcagcataatggaagaaaccacttcattgatattgaatttaaatttcagaaggccgatcagcccgcctaccacagcccctgcggctacaccgatcaggagaaccagaggcttcgccagaaaagcattcaggccgctgtagcccaccaggatagtggcaaggaagcccgccgccagcatctgtcccgacacaccgatattaaaaagcccggtacgcatggctaccgccaccgcaagcgcggcaaaaatcataggcgtcagataattgagaaagcttaaaaagtccgtaagtatactcttatgtcccgcataggaagccttcggcgcaattccgcagccctgaagaaggttataataagccataaaaggattctttcccagcacggcaatgactatggctcccacaatcaggcctatgagtacacataaaagcgggatggtcacactctgggttttcttattgccaagggtccggcttatcactctcttaaagacagattcttttttatgcatgccgcttcacccccatcataaattctcccacctcattggtggtcagcgttttggcatccgcttttttctgcatctgcccgttgtaaataacgccgatggtatccgcacaatccatgatttcgtccagttccagagatatcagcagaatggcctttcccttatccctttcgccgatcatctgcctgcggatattttcaatcgctccgatatccagtcctcttgtcggctgcacgaaaatcatcagatccgattcctgttcgacctctctggcaatgatcgccttctgctgattcccgccactcatggaacgcacaacagtccgcactccctggccgcttcggatatcatatttatcaataagggtttccgcatagctgtcaaaggccttcttattcaggattccctttctggaaaagggctctttaaaataattccgcagtcccagattctccgataaggtgaaatccattaccaccccgtaattctgcctgtcctccgggatataggatatcccttccagactcctttgacggatggattcccccgtaatatcctttccattaagccatatcttccccttatggacgggaagcagtcctgcaatggcatccgccagctcaatctgtccgttccccgcgacaccggcaatggcaaaaatttctccgccccttacagaaaaggatacatccttaaccacttcaaactgatcctggttcacaacagtcatattttccacccgcaggatttccctgccgaaggaaggctctttcttaggggtttcaaagctgacttcacggcccaccatcaggctggccattttcttagtgcttgtttccttcacatccagcacatcgataagacggcccctgttcagaatcgcacagcggtcggccacctttttaatctcttccagcttatgggtgatgaggatgattgtctttccgttttcccgaaggcccttaataatatccagtaaaaattcgatctcctgcggggtgagcaccgccgtaggttcgtcaaaaatcaggatttccgctttccgataaagcatcttcagaatttccaccctctgctgtgtggaaacattgatgttttcaatcacatcggtgggctccacctccaggccgtatttctgggaaagcccccggatatcctcgttggcctttttcatatcaacggcaggaaacagccccagcactttctttaccggctccatacccatcactatgttttccgcaatcgtataattgctgaccagcttaaaatgctgatgcaccataccgatattcagtttcgtggcgtggttgggggaagaaatctttaccttttctccccggatatagatttccccttcatccggctcgtacataccgaaaagcatactcatcagcgttgactttccggcgccgttttcccccagaagggcgtaaatctcccccttctttacctgaatcgtgacatcgtcattggcaacaatgcccgggaaccttttagtaatatggcgcatttccacaatataatccgacatacattccctctcattccgccgtttcccacggctgtttttccaagatatacttaggggatgccatcagcctcatgctgacatcccctaaatataccccttcgtacaaaatcacctgacggtgattcttctgcttccttcccggcaggcaatttcccgcccgacggacaatttcccccaacgggaaatatataaaaagcaggccggaaccccggcccgccttcccttttctcaggatctgcagacgcagttcctaagtacgttccttactctactgtaaaatcatcgggagtaataccgttgaagttggcagcaggtacaatgtctcctgctttcactttttcataagctgcatccagctttgtaatagtatccgcagaaagctgacatctgccggaagcactcacataacctgtggaatccgtatcagctcccagagttacgttgccgcctgcaaaagaaccgtccgcaattgtttccagagccttgtccacgtttgtgctcataaccttcagaccgctggtcaggataacgttggcatctccgtttgcaccatcatcatactggtcaacatcacagccgataacataaacgccttcggcttccttagccgctgtaaacacaccgtttccggaatcgcctgcagcaacgaacatgatatccacgccttcatcgataagggcattgccaacaaccttgccggttgccgcatccgcgaaggatccgatatagttgccgcccacattgacgccggtaacatctgttcccgcataagaaggaagttcaacgatttcaacagactttccgtcggtttcattcacatatttaacgccgcattcaaaaccatactgatagtttacattggaaggatatgcaataccgtttaccacggcaaccttattgctctttgtttccagagcagccgccataccggcaaagaatccgctttcctgctctttaaactgcatcgcataaatattttccacttccgtatcctgtccttctgcatcagcagggaaagcatctaccagaataaaggcaacatcagggttgtcctgcgcaacctgtgtgatacctgcgaactggaaaccacagcatacaatcacatcatagtcagctacgatatcggctactgcctgtactgccgccgccgtatcccctgtaggctccttaacaggagttaccgtagaggaaggatgctttccgataaaggaaagaataccgttataattgtcctcattaaaagaaccgtcatccacacccgaggggctggacacaatggcgatcttcagtgcgtcatttcctgcttcggtggtttctgcagcagcttccgaagattccggttccgcaacagattctgcagcagcgctgctttcaggggctgcactgctttcaggagcggtgctgccggaattgccgcaggctgtcagagagaaagcaagcacagcagcaattgcaagagaaagtgcttttttcataataaaaatcctcctttttagccgtccgagacggccttcatcataatcccgtggaagcttcgcttccattctgtctgcaagcggttccacaataaaaaacctgtcgaaaaaaaccacattacaaacaattacaaattaatcatagcattttaacggccggttgacaatgccaaattcttatttccatatagttaaagtaacgatgcagctcccgcttcgccagttgggatcgggccaccgggatcggccgtcctttgtccccgcagcatccccggttatacagaggtccttagaggggacgctttcgctcggataaccacgcagcggtactaaggctgcaaaggacgcagcctaaggaccggcgtgtttataacgccccttacaggatcctctgtataaccggggatgctgcggggacaaaggacggccgatcccggtggcccgatcccaactggcgaagcgggagctgcatcgttactagttaaataatgtccatgacatcttttacggactgtacgccaatcagccggatcccttccgttttcggcagcttgtccaggcataccttgggaaggacacaggttccaaaccccagcttcttcgcctcggacacacggatggccgcctggctcactgcccttacttcaccgcttaaccccacttccccgaaggcgatcatatgctcttcgataggccggttcttaaagctggaaattaccgccatgacaatgcccaaatctatggccggctcctgcaccttcattcctccggcaatatttacataggcgtcgcagcccgatatctgcagccccagacgcttctccaggaccgccattaaaagattgaccctgttaaaatcggttcctgccgcctgtcttctcggaaacccgaaattgctctgacagaccagtgcctggatctccaccagtatcggccttgtcccttccatggagcaggaaaccacggagccgctggccccttccggcttcccgttaagcatgaactcagaaggatttttcacctcacaaaggccttcctggcgcatctcgaagaccccgatttcattcgtcgatccaaaccggtttttcactccccgcagaatacggtaggaggcatgtctgtccccttcaaaatacagaaccgtgtccaccatatgttccaataccctggggccggcaaccgtaccctccttggtaacatgtcccacaataaatatggatatcccgtagcccttcgccagcttcagaaaaactcctgtggattccctcacctgggaaacgctgcccggagccgcggaaacctcctcctggtacatggtctgtatggagtcaataattacgatttccggcttttcccgggtaatcgccccttcgatttcccccagattggtttcgcataagagctgcagggtatcgcggaactgtccgatacgctgggccctcattttgatctgctgcagggattcttctccggaaatatagagaacctttttccccgattccgcaagaagcctgcacatctgcagcagaagggtggatttgccgatgcccggatctcctcccacaagcaccagagaaccgggcaccactccgcctcccagcacccgatccagttctccgattcccgtaagaatgcgctcttccttgtccatggaaatttccgacaggatggaagggcgctttccctgggaggaaagtccctgggagcgttccgcggctccgccttttccggatgactttctgaccggttcctccacaaagctgttccatgtatggcagccagggcactgtcccatccatttcgctgattcataaccgcattcctggcaatagaatatggttcctgattttgcctttgccatttctcaaaaaggggtgcggctgataccgcacccctgtcctcctgtacttttttccgattagcagtgcctatttatggatgtctaccttcacttctcccgctcctgcaagttccactgaaagactcagctttcctcccagatttgtgcacattcttccggcatcctcttcgttaatccgtacgtcatattccgtatcatcctgaagtccgatggtcagctgggcatcctcctgtccctctaccacaaagcttacgccgtcctcgctctccaaaaagttcagcacgctggttcctggtacggattcataaacgaacataccgtttttctccagcttcgtcatcgtctgataggttttcaccttatacagatctccttcgtgggaaaagtcctccagcttcgctttctccgcaagggtgtggtttccaaaactgatgctgccgtctgcctctgcacggattaactcttctactactgccatttcttttgtcctccttaaatatggttcgtccttttgctttatcctccgtcaccgacggtattcctctatttttttacctgaaacgtaatttttccttccttgcagcctacggttacattatctcccggctgaatgcgtcttgcaaggatttcttctgccaaagcgtcctcaatcatattctgaatcgctctcttcaaagggcgggcccccatttttaagtcagaatgcttctccacaataaaattctttgcggcaggcgtaatggtcagatgaatattcagctgcttgctgcaccgatccgttaaatctctggacaggagcgtgatgatctgtttcatgttttccttggtcaaaggatggaacaccatgatttcatcaatccggtttatgaattccggcttgaacaggcgcttaacctcttccataacgccggccttcattttttcatagtccttcttttcatccgtatgggcggaaaagccgagattcttgggatctatgatgcgctgtgcaccggcattggatgtcatgatgagcaccgtatttttgaagctcactttcctgcctttggaatccgttatatggccgtcgtccaacacttgcagcaggatattgaacacatctggatgagccttctccacttcgtcaaacaatacgacagaataaggattcctgcgcactttctcggaaagctggccgccgtcgtcaaagcccacataccccggaggggatccaatcagcttggaaacggaatggccttccatatactccgacatatcgatacgtatcagagcattctcagaaccgaacatcgcctccgcaagagccttgctcagctcagtcttcccgacacctgtaggccccagaaagaggaaagagccgataggccgcctgggatcctgaaggccgaccctgcctctgcgcatggcccgggctacggcgctcacagcctcttcctggccgataaccctcttatgcaggattccttccagcttcagaaggcgctcactttctttttcctccagcttgctcacgggaattttggtccacatcgcaaccacgcctgcgatgtcattttccgtaaccacttccttttgggctgcgttcttcttttccagccgcatcttcctctggttcagcttcttaagcagtgcatcctgttcccgcttccactcaccagcctgggcaaaagcttctatccggatagctccttctatcttcagatccagttccttcacctgttcattcagcttccggatatcctccggcggctccatatgctgcagccgcacggcagacgccgcttcatcaatcaaatcaatggctttatccggcagcctccggtcatttatataacggcttgacagccttacagcagcttctattgcttccggaaggatttttaccttatggtgctcttcgtatctgggcgtcacgccctcaagaatacggacagcctcttcttccgtaggctcctctacattcaccggctggaacctgcgttccagtgcggcgtccttttcgatatatttccggtactcggtgatggtggtggccccgatcagctgtatttcccctcttgccagagaaggcttcaggatattggaggcatcaatcgcgccttccgcaccacccgcaccgataagcgtatgaagctcatccaggaacagaaggatattgccgtcatcggtcacttcccggatcacttttttaatgcgctcttcaaattcgccgcggtacttgcttccggctatcattccggataagtccagcatcagaacccttttattctttaccgtatcggggacctcgcccgctacgattctggcagccagcccttccacaatggcggtcttgcctactccgggctccccaaccagacaggggttattcttcgtcctccggcttaatatctggatgacacggctgatttcctcttccctgccaataaccggatccagcttgccgtccctggccagtgccgtcatatcgcggctgtactgctccagagtgggcgctcccccttttttcttctgctttttcatcagatcctctttatacagcccgggctcctgtcccatggccgccagagtatccatatacagcttctgaggctgcaggccgcaggtattcagcaatctgacggccacattctccccttcctttaaaagggaaagaaggatgtgctccgttccggtaagtgcactgcggaatcttgctgcctgtctgtggctttcctcaagaatagtcatagcccggggggaataaccatcccgttctttaaccggtgtttctgataccggcgcgatcaaatcttcaatcatttcacggatttccaattcattggcaccattctctatcaacactctggctgccacaccggtgccctcctccaggagccccaaaagaatatgctcagttcccacataattctgtttcagcttcctggcggccttctcagccagtataagggccgttctggccttatccgtatactgtgactgcattattccagtcctccatattcttcataaatttcgtcaattaaagcatgcacttcttcccgggaaatattcttgcagctcgccttcgccagcaggactctgagttcatcccggacatccagcatagcctgcttctttccctcgtcaacagcgattaccgcgccttttcttctgtctaccttcacatagccttcctgtttcagcacggtatatgccttattcaccgtatgcatattaataccaatggtgtcggcaagctgtctcacactgggaagtacatccccctcatgaaaacggttggtagcgattcccagaatgatctggttcctcagctgaatatacaatgcctcatcactgctgaaatcaatctctatatacatatccaatacgcatcgctcttctttctgtgtttcttttgttatatttatagtataacagtgagcacatcctgtcaaccgttttcatcggacgccggcgcatgccgttcttctctgttccagtctattccatataaagattatgggaaaaagccgctgcagtccatcccagcggctttatcttttatctgcggctgttatcagtcagccaggtttttcttatttcaaatccagaaattcaaaatccagatcgtcatcctcatctacatcaaggaagtcgcggggcttataattctgggacttcctgctttttcctgaagaacgggagctttttctgggcggctcatcataggacacttccctggaatacatatcatcctcatcctcgtcttcgtccatatcctcgtcgtcttcgtcctcatcatcctcttcgtaatatctgcttctgcgggccggtttctttttacttctgcttcctctgccgcctctgcttcttctggggacatagtcgtcgtcatcctcgtcgtcgtccatatcctcatcgtcgtcgtcttcatcatccatgtcttcatcatcttcttcatcgtcatcgtcgccatattcgtcatagccgtcctcatatgccgctttcagcttgaagatcatgacggttaccacaatgaccaggagaccgataataacggcaagaataataatgataagccggagactgcctgtctgtttttccatggtatcgatattattttcattcgtctgggccgcaccgagaagatcggaaattttatacctggtgcctttcacattgtcgttcaagtaccagtcattatttcctgtcccgtcgtccgcatagctcacatcataatcattggtggaaggagcggtgtccgaaggagcttcggagggtgtttcctcaggagtttcagccggagcctcaggctgggcggtctccgttacctccagtgtatcttcacggacataaccattaatcgcctttccatccttttcccctgtgatctgataccagactttcccgtcacttcctgtcgtctccccggtaacatccatgacatcacctgaggaaagactgcctaccacgctggagctggttgaggcttcagaacgaacacgcgcactggccgcaataatcttgattttagatgccgtggatccgtttatgccttcctcagagttttcgttgatgatgttgtttacttcctcatcatctatattcacttccgctccgtcagctccccctgcatctccatttccctcattactgctgctgccctgacttccctggctccccagcgtattcgccgcatggcctgtcagagcggtctgccccggtagagcagcgcagaaaataatcgctgccataacagctgttaaccgaagcaaaaatcctgtacttattttttttatcctgttcatgttcctgacccctttaccttttgtggtttacgcctcatctatagctttaccgatatccgtacgcatatacttattggcaaagtctacccagccggccgctttataggcattggccctggccgctttcagatcgtctcccgtagcggtaattccaagcaccctgccgccgttcgtcacgatatttccctgactgtcgaatttggttccggcatggaagcaataatacccgtcggcatctttgaatttttcaagtccgctgattttcaggcctttttcatacttcacaggatatccccgggaagcgagtaccacacataccgcagcattatcttcaaactgcagatctattttatccagcgtgccgtctatgcacgcttccatcacatccacaatatcatttttcattcggggaagcaccacctgcgcctccggatctccaaatctggcattatattccagaactttgggacctttctgtgtcagcatcaggccgaagaaaataattcccttgaattcccttccttcttttgccatggcatccactgtgggctgataaatatattgtttacagaaatcatccacttctttcgtataaaaaggggatggggaaaaagttcccattccgccggtattcaatcccttgtctccgtcacaggcacgcttgtgatcctgggcggaggtcataatccggatggtttttccgtctacaaacgaaagcacggacacttcccttccggtcataaattcttccaccaccatacggtttccggcagcaccgaactgtttgtccagcataatgctttttacaccctcaagcgcctcttccttcgtattgcagatgaggacgcctttgcctaaagccaggccgtccgctttgagaacaacaggataatccgctgtttccagataagtctccgcctttttggcatcatcaaatgtttcataggctgccgtgggaatgttatattttttcattaaatccttggaaaaagccttgctgccttccagaatggcggcattcttccgggggccgaacacgcgcagacccgccgcctccagcacatccacaagtcctgccgccagaggatcatccggtcccacaatgaccagatccacttctttttctttggcaaaagaggcaattctatcaaactcatccactccaatgggcacacattccgccacctcggcaatccctgcgttccccggagcacaatatattttatctgctttcgggctttcagccacggccacagcaatcgcatgctcacggccgcctccgcctacaatcagaattttcatttgtatctcacctttccgtctgttacgcttactttcccgttggcaatcaaatcaatagccctgggaaggatctgccactccgcttcttccatcacacgcagctgaaggctttccggcgtatcatcctcctgcacctccacgcttttctgcagaagaatcggccctgtgtctgtcccttcgtccacaaaatgcacggtggctcctgtcaccttaacaccccgggccaacgccgcttcatgaaccttaagcccataaaaccctacgccgcagaaggaagggattaaggaaggatggatattgatgatacggttcctgtaattttctatcatggcagccggtatggtcaccagaaaaccggccagcacaatcagatccggactataggagtccaccttatcaagaaatgcctgattgaacaccgccctgtccggaaaatccctgggtgaaaggcagacggcatcaataccgctctgcctggccctggttaacgcgtaagcgtttttattattgctgatgactcccactatctccgtattggttattctgccgtctctgatagcatccataacagcctgcagattggttcctccgccggatacacaaaccagaattctcagcataattcaactcccttttccccggccttcacttcaccgatgatataaggaatttcccctgcttcacgaatggccgccacagcactttccgcctgtgcgggatccaccgccagaatcataccgattcccatattatatgtattatacatcatctgctcatcaatattacccttgctggcaagaagtctgaaaatggcaggaacttcatagctgtccttctttacgaaagcgcgcacgccttcaggaagcatacggggaatattttcataaaatccaccgccggtgatatggctgcaggccttaatggcaactcctgcatcctttactgccttcaatgctttcacatagattttggtaggggcgatcaacgcctctcccaacgttttccccagctcctcataataggtatccagggattccttagtcatttcaaaaacttttcttaccagtgaaaaaccattgctgtgaactccggagcttgccattccgataagcacatctcccggcttcagattttctccggtaatcagcttcttctcatcaacgatgcccacggcgaaaccggccagatcatattcatcttccggataaaagccgggcatttccgcagtctcgccgccaatcagggcagcacccgcctgcttacagccatctgccacaccttttacgatagtggcaattttttcaggatagttctttccgcatgcaatgtagtccaggaaaaacagcggttccccgcctgcgcaggcaatatcattcacacacatagccacacagtcgattcccaccgtatcatgcttatcaagcagaaacgcaagcttcagcttcgttcccacgccgtccgttccggaaactagagtaggcttttccatcccctggaagctttccagggaaaaagcccctgaaaatccgccaagaccgcccagcacctcagggcgcatggtttccttcacatattttttcataagttctaccgatttataccctgcttcaatatctacaccagcgttcttataatccatcatgtcctccgtttatacgaagcccgtcaggtatcgccatccgggttcccgcattgtttttatctgcttatttgctgtaattcttatagcccgcttcctgaagatgcgcgtccttcttctgaacgctttccttaaggccctgggaataatttttcaatttctcaagaagcacggcatccgatgtagcaagaatctttgctgcaagaagacctgcgttcgctcctccgttaatcgccaccgtagccaccggaattccgctgggcatctgaacgatggaataaagagaatcccttccgccgagagaagtcgtatgcataggaataccaataaccggcatagggaaaattgcagcacacatacccggaagatgcgcagccatacccgcacccgctataattaccttgaaccctttttcttcagcgctctttgcatattcaaaaaacacatccggttccctgtgtgcggaaataatcttcatctcataagaaatccccagctcctccagaatatcagccgcctttgccattacaggcatatccgaatcacttcccattacaataccaacctgtgccattggttctcctccttcatcctcttggacctgatcccgatcccctgccgaaggctccacacgcccgtccactcggcaaaagacccgcaaaatcaagccggtaatatttcaacctacagtgtactaaactttttcccgatatgcaacatcaaccaccccgaattaataaaaaattcaacttttactcccaaagggatattttttttggagggaatggattataatattgttaccaacgagcagcaacctcgtgaagaggaaaaccagaatgggaaacaaccggcacgccccaccgccggctgcttcccagtacagtgttgcattaatattacagtaatgagtgcttgatattcctgtcagcacaaggcggaggagggaggcgatgcggtggcatcgttgaccgataacaacgcggtgctggcaggaatagcgagtgctcattactgtgatattaatgcaacactgtacgaggctgattttcatcttcacgaggcttggggcgactgccccaagcccggaagcccccgggcttccgggtctgcggactaccgccttaaatcccctatgcccttacgcccttaactcaccaccaacccaatccaccaccaccagggagatgaccaacatcatgtgcgaaatacaatacgacatcacctacgacgacctcaaccccacgttccttttcacctgccagctgtcccgaaaggaacccgaactcccccatagccacgacttcatagaaatcgccctgatactctccggggagggccactttatgctggacggaaaatggtatcccgtcaaaaaaggcgatgtactcctcatcaacccgggcatccagcaccactgcacctacataaatccggatgctcccctggaagaatcctacgtagcctttaccgacatccacatacgggacatggaacgcaaccagatcctcttccccggccacgaatgcctcatccgccccggtgaaaagacctttgtcaccctatcccgcctctgctccctcatcaaaacagagagcaccagctgccagcccgggcgctacttcatgctcaaagcctacgtcacccagatgatcctcctcctttaccgcgagcaggtcgctgcacccgtaagcatagaggacggctacgaatttgaatccaccaataaaaaatacgtcgtggaacaaatcatcgactacctggactgccactacaacgaaaaaatatcccttgatcagatagcccgcaacatgtacctgagccctttttacatatccaaaatatttaaaagcgaaaccggtgatacccctatcaaccacctcataaaggtgagaatggaaaaagcaaagcttctgctggacaaacaaaaggatgccagcattcaggacattgccttgtgcgtggggtatgacgacgcataccacttcagcaaactgtttaaaaaacactttggggagtctccctctaaatataggaagaaacagatttaaacagcagaatacaggccaggattttcataagacctggccttataacatttacactcttcccaatagctgatataataaaaaggcaccggccgccgggactatgtgtaagctcctgcctgccatattacagttgtatcaatcagcatttcttttcgtataatatttcaatctttctgtccgaatcggacaattattcaatgcaagttttcaggaaacaattctacgaatcaaaacataaaagaaccttagaatataatcgttttaaaatgtaagatgcggttgtccggtgtcggattttcagttataattatatgaaagacaggattttgcacatggcttacggaacaggaggctgtgtgagaaaacgcacgaaaaagattaacaaaatgctggaagaaaagaatccggcaactaaaaactccattcatcatgaagatttggcgctgaaaacagcggctcaatacttcggtgaagagctgatgcccctgtttggaattcagggtgtggccgactacatcgctcctacggagactgtaatgctggaagcgcggcaaatgtatcagtattttaactatgtacggaaggatggcgtctggatccatttggaattcgaaagcgattccattaccaaagaagatctgaaaaggttccgggaatatgaggcatccaccagccgcgtacatcatgtggaagtgatcacctatgtaatctgttcctccaaggtaaaacatccgagaacaatccttaaagaatgaattaatgtttaccaggtaaaggtggtacgtctgaaggggaagaactcggaccagcttttcaaacgcctgaaagaaaatgcagaacaggggctgaagcccacaaaggcagatcttgtttccctgctgctcacaccgctgatgtcaggccgcctgaggatcgaagagcggataataaaaagtctgaatattcttcaaaattccagagaactaataaccgaagtggaactggaaaaaatgcaggcggttttgtataccctggcagataaatttttgaatgagacggaattaagcagagtaaaggagatgatagcaatgacgaaattaggagaaatgctggtagaggacggaatcaaaagaggtatcgaaagaggattggaagagggaatggaaaaaggaatagtcgaaacttgcagagtataatgtacccatagatgtggacacattaagaagaagggttccttgaaaatggacactatgaagaagggatgccccctccaaagtggacagattgaaaagggggttctttatctctgatagatgttgatatataataaaaacatctaaaggagaaagatatgcgggaatacacagtaaaccagatgaagcaacttaaggaaaataagtataccctgaatgtcacaaagaacaaactgtatttcacagccaggtttaaagaggatttctggatacgataccaggctggagatgccccgagaaagattatagctgatttaggttatgacactaagctgtttcaacaaaaacagatagacagcattgtgcagagagtaaagaagcaggcgctatctggagatggatttacagagggagaaaatcgaaccaaaagagttcccatgaaacgaataaactcaaatcatgaaaaagaagtatccttagatcagatgcagcatgagctgctataccttcgtcaggaggttgagtttttaaaaaaaaattataaaagcagacaactcaaagcagaaagacggatgatgaatgaatcggactgtaaatttgagattatatacggattagtaagcaaagaagataatctgttatcagttacaatgctttgcgatatagcaggagtatcaagatcgggatactatcgctgggcaggggccgcagatgaaagacagaggaaggaattaaaagatcaggcagattttgaaataattcttggagcgtatgctaaacgtggatatgataagggcgcaaagagcatctatatgacgctgatacatcaaaatccacccataattatgaatgtaaagaagatccgccgattgatgaaaaagtatggacttgtgtgtaaaataagagctgcaaatccatatagaagaatggcaaaagcaataaagaccaatcatgtcgcagacaatctggtaaaaagacaattcacagcttatggagcgagaagggtactgctgacagatataacatatatcccttataatggtgtattttgctatctgtctacaattttagatgcttttacaaaacagatattgtcttatgttttgagcgaatcactggaagttgattttgtactacagacagtaaaccggatggtagaaaaacacggtgtgtcgttaagtgctgaagccataattcatagcgatcagggctgtcattatacaagctgtagtttcattcaattagtaaaggatagaggattgagacagtccatgtcgagaaggggaaactgttgggataatgcaccacaggagagcttctttggccatatgaaagatgaggtggatataagccggtgcaccgtctttcaagaggttaaaacaattattgatgactggctggattattataataatgagagatatcaatggcagttggcaaagctatctccaaatgagtattaccaatatataacaactggaaattatcctcttagaggaataataaatgaaccagaaaaggaagaagaaatataacaatatctattcagaacatagtatcccttcttcttaaatttgtccttgacaaggggtacactttagtcgaaacctgccgagaactgggtgtcagctttgatgacactataaaaaagataaaacaacgattcggcatcagcgaaaagaaagcccaggaaattgtcaataaatactggctttaacaaagtattggtggcagctcccataccaatacgcagcagatttttcttttcctgtccccccactatacagatataccatgacccacagaaaagtccatgaaggaaacaaagttcaccccgatggctctatccggcttctgctcatcggggtgattgtcctaatccgcaaaactctatgattatctgtctgaatactaagtatattatctgtaaagtttttaataaatatatgttctttacatttctatgtctaataccccctatatacccagcctatcataacgttctgtcatttcataatatctatcccatccatccggctgatttacactttgaaacactgtgggtttcaggcccgcttccaacattttttctataatacaagcagataagcaccacataatataagcagcggaaataccggaagagggtgcaaatctgccatctattccatctatggaaagcatggcgtctccggggccggaacaattatcaattaccatatctgctatttcatatagacgctttccgcagctgtgatcagaactgacagatgatgaataggccatagaagttaccgctataacggtaagacccagcttatgcgcttccagagccatatcaaccaccggaaccgtttttccggaaacagatcctataatcagaacatcccccggcgctgcctttgatgcacgtaacgcatagcctgcaaggccttctctgttatccgtaatacccttacgctcgattgctcttgcagtactgataacctcaaaggtatatctaagtcttcgcagaagcgccagtccacccgcccgatccaccagctcactgtcaatgatatggccggtatcgtatatatgaatcccacctccttttttaacagctgcaacaatcaaatccgccgccttttcaacctgactccattgcgtttctctgactcgatccattacttcttttattgcatggtcatatttttcaattaacatttatttcctcctagtataataatggtgtagtcaagaacgactactaagttaaaagttacaaagtccaatctaatcaatctatatagatataacggaaggaggagttctccctccatcagaagttataaggcaaccttatttaccttgcctgaggtttccttcatgcaccagacaaaagatagaggtataatcacggaaggcaggattatggacgtttcctccttgggaaccggccttttggctggtgaaacctctaaaaaagtctgtcagtccattcggtggtgatttatgttttggctggttgggatgccccaggctatacctgtataacccgctaggttgtgtatccaccttctggaattggatacctgccagaaaggatcaagttatgcactatcaaaaagttctcaagatgctggaaagcatcccctatctctctgtagggcttgatgtcggcgctgatttcacctggatgtccatcatgctcccaaatggcctcctcactggaaaaccctttaagatcatccactccgatccgcagtcccgtgagcttgctgtcacaaaaataaaggaagcacaagagacgtattctctcaaaagccgctgcttccttgagtccaccgggatctatcacatcccgctcctgtgcttccttcgtgataaggggtttgactgctccgtcattaatcctatcatcactaagaatagcacaaatatgaacgtaaggaaactgcataatgacaaatttgattcaaaaaaagcggctagagttggactggatgcttccctaaagacttccatcgttccggacgatgagatcatcgacctacggaacctggtccgtgattactattacttcaaagacctacagtcggcggtcgttctcaaactacatgcagaactgaaagtttccttccccgcttacctacaggtgttcagtaagatcaccacgcagacttccttaaaccttctatatgcataccctcttgccagggacatgcttgccgctccaaaggatgacatcatcaaaaccatccggagcacagcacgctttggggaaatgtatgcccttgccaggtatgacgccttatacactgccgcgaaagattccgaattgttcgggcgcgcccttcccagcaatgccctccggattaggctgtacatagattcttaccgggaataccaggggcatctggactccattctgcaagaactgcacaaggctgtagatagacttcaggggaatcctgcatataaccgcatccgtctcctacagtccctgcgcggcatcggctttttaagcgctgttgtcctaatcgcagaaatgggttcctttgacttatttccttcacccaagaagctctatgcttactttgggttggatcccggtgtaaatgattccggcaagctcaggggagacagggtccacatgtccaagcgggggtccggtcttgcgcgtcgtatcctgcatatgattgccataaacaacttaaaaatggagaaagggataaaaacacctgtaaacccggttatttatgactattacacccgcaaatgtgccagcaagaaaaagagggttgctgtcggagccgttatgcataaaatctgcaacatcattttcgctatgctgcgggataacaaaccttttgagatcattacacccgaagagcattgtaaacgctatgtgacagaacagtctgccaaaacagaaacagcagcttaaagatccaccactatgaaatttttaaattcccatatccgatgggtttattaaagtcgcctttttttacaccaactgctcaaaaaaactttttaaacatttttcactttatttcttgacatttcttagctggacttttcccaatttcttattagaaactgagggaattccttctttaactcctccagcctctccgtcgcatccccctcctgcttttccaggagagaaaggataacaccacccataaccggctcaaaaaccggcttacgtatccgcgcggaaggaatctgcacttttaattgttctgaaaagctttgaaacagaaaactgctgctcttccatgctccccctgcagccaacacaaatggttcctgctgttcagcgtttctcagcatgactgccgcctgaccggaaagctcacatgccgcctcatataaaatctccagggcggcctcatccccattgtctgccgccatacctacccatctgcaaaaggaagctacttgttttaccgcaaaggaatcctcataaatcacgtgaagcagatcccacagtcttttcactccataggcctgacgggcaaaatctcccagacaggtttcctttccccacttttcttctccgcggatggcggcctgcagccctttctgaccaataaaaaaaccacttccaaaatctcccagcaaatatccccagccgcccaaatgtgcttccccggatcccacctgaaaaataccggaacccgtcccggaaagtactacggttccttcccttctgaaactgcctgccagcaaacacgcttcaccttcattcagaggacagcagagaacattgggagagtgttttttcacttcttgaaaaaaaatatcgttttctgccaaatcttcctgctttcccatccagggtgccgcaagaaaagcacgcctgattcgtccgggaggcacttcggccaggcattccgaaagagcttcctctatctgtcttcttttctcctctatggaaaagcagccgtttacaggcccgccataccctgccgcccgaaaatggaagtcatcatcaaaaacagtaactatcagcttactcccgccgccatccgcgctcaaggtataatacccttcttccatatatcctcctacctatttgcccaggaattccttttccgatgtctccagtgaggtccattcgcgtatctgcgtaattcccgccttttttacatctttaaaaaaatctcttattcttgtctctctatccggctcatcaactgacagccgtgccaatctcacataccggagagcgagccttgacgtcctgacacgagaaagaatttcctcattatcagctgcagcctctgcataatcaaaaaacctgtccccttcctccagcaatgtctcatccagatagacggcatccgcagaatcataaatgctcatatgtaccccaggagtaattcgtttctgacaggcctcaatccatctttttatccatggtgctgccataccataatagccggcaaggaattcctccatgcatacctccatgtcgatatccggattccataacagccgggcaagcagatactggctgagacggttcaatcccccgctctctccctctgcattatttccctcttcaaagattccccgcacatgatttctgatcagaaactgtatattctcctgcagtacatcaaaatcaggaaacggctgcagatagttagcaaaattggttgtgtagtcccaaatataaagctgtccgcagattttcccccaatcttccaaatcctcggtaaaactcctgtggcctccttcctgatctcccccaacggtaaccgtttttccgcattttgaaagcggatgggaaaagcagcattcaatggagcacagacgcactatcacattgtggcggggcctggtaatccttggaggcctgcgggtatactgataagccaacgtgtctatcctcagcctgggataatctttctccagcgcctctgcgatcctgttgacaaagcgtatcatacttcctgcgggacttccctcctcttcatctgtttttctgcatttttcacaggtacatgccccggcacagtcattctgggagaccgaaacaatggttatatccggatcttgatcaagacgttttctgagctgccctaaaacaatctgaaaaacatcctcattactcaggcacagctgtgccctttctcctactctttttccatttatctgtgcataatattcaggatgttctgcaaaatacttttccggaggcaccattgtgtaaaaggaatggacaaaaggatcatattttacccttcctcccagacgggatgtgatttttgggaaatggccatttgaaaaattacgcacatgccagttcggatcctgatttcccagaagatacggttcacggtattccagggccggtgcctctgtaatatcaatactgccaatctccagcatattgcgtcttggaatatgacttacctccggtgtaaaccagcggcagcccaggtattttttgaggaaaccatatacgccatacaaagttcctcttcctgtatttccggtaatcaccaaatccattcccacggttcggatcagaaatccctcttccttcagttgtgttaactcttccgggaatatgaaagattcacaaagccggccgcagcctaccagtatcaggttgtccttctgatcctcctttattttttcttctgacattaccggaaaatcagcgccggaaatttcttttaaaaattgtttcagttccacggccgcatactctccggcctccgaggcgtcttccggaataacgattgtatattctgttcttccgtcctctgctaaaatcagcctgccattcttcatagaaatatctcccttcccggatttcaatgttccaaaaagcttctcagctgcttcatttcaagtctttcctgcggacaaaaactatcactttccagatatctgagcagacatgccttcagccaatgggacaccggccgatcctgcagaatctcctgcaagcctgcactgcataccagaagacttcctttttctacagatgcttcaaacaaaattcccagcttccggttgctcataaaggaatcaatcacccgaatcaatggtgtaaccggaagcatatcaagattcataaccctgctgtttttcaaaacatcccaccattgccattgagtatagccttcattgggaaatcccttcagggcaggtattgatggttcacaacagattccgaacgttcctgtctgtttcttcatctgaggattccagaataccgtggtgaatactccgggtatgctgtcgggaatattgtccggaagcagaagaagcctttctcctgaccgaagcctgtcctcagcacactcatccagacatgtaatgatctgtgggctgtccaattcctccatctgaggatatatccagaaatcccatgcattttcaacgcccttttccaaaagctccagcttcactttcagctgatgagcttccttaaaaaaagggaaattgaacttaaatgtccccaggctgtttacctctccgggtattatctgcgcactgcctccgcccgctgtaagggtttcccccatatccgtcactgtatatctccagtctgcctcataaccctccgtcctgtaattggcagccaaagcttctccttcaaaggtttctcctgccatataaacccttttcccactgcgcagaagcatcgtaagggaagagcagaaattcctgtattcctcaggcaataccaaccccttactattccagaaggcatccaatattcccacggtggaagttccctgcccgggataatccgtcaaatccaacagctggaacccgctcaattttctgcttttcagcatggtctctatttcgtctctatagagcatcagactcagcttccctgaagcttttacaaaggacggaaccaactccagcattccttttttctccagatcttctctgattaatttcgggttccccgcttccaggacaccgcaaaaacgcggaatttcccttacatccgggaaaacctcccattgtcctgcctcatggcagataaatggccggtccgcatccgaaagtccctgatcgtagtcagtatccagtgcaggcggctgcgtacaataaatgcaggtatccaggggatccggtccgccccacataatagcattcaaataataatctctgttccccgtcaattttcctgcttttgccgcatcctgccccttcaatgtccatgcggaaacaaaataatcggaaacactttcccgggtacatggatggctggtacaggtatacagatgtctggaatccttttttcttgcaaactcaactttttcgttcagtattttctgatgccctgcaagcatttccggctgattcattgataccaactgctcatttcccatagaaagcataccgaaagaaggatgtcctccataacagtcaaggatcctctccaactcccgctgcagaaaaagtgtgtcttctttttcttccggtttgtcaggacaggaagagccgccaagctcaatctgcagcagaaagcctgctctgtccgccgcattaaaagcggcttcaggaggacagaaggaatgaaaacgaaaatgattcaatccataatctgctgcaattttaaagatacgatcccatgcccccctgtcacatggtggtgcaaaggtaagcggaaacgtacagttctccaccgttccacgcagaaaaatccgatgtccgttgagtataatatgaccgtcttccgcttccagataccgcaggccaaagggcactgtacggcagctctcccttttccccatctgtaaagcaaattctatctgatataaaaccggcgtaaattcattccactgtgtcattccttccggcagatccaggacaaagctgcagtattgaaccgcctccttggcaatcggcagcttcttctcaccggacataagacaggtatccagttcgtccttcagttcaaaatgtaaattaccttctccactacaacccgccttattcttaatccgcagccggacctctattttatccaggctttttagtggataaatttccgccttttccaaatgcaccggttcctgcgcacgaagttccataactcccgtcaccccgttccagttagtaggcatcagaaaagaggtatgatgtccgccgcaattgcgtttccggtgtctgctgaaaccgctggaaagatctctgcagccggaggtatccatatccgcagcattttcatccccaaggttggaattatccaccatcagtgtaaaaacatgctgccccggtgttatgatatctgtgagatcaaatacatgcggggccgccagagattcccctgctcccacaaactgatcatccatccagagcatcgtatcccacagacacctttccagaaaaagggttacatattttcccgaaaaggattccggcacccatatttttttctgataccaggcctgtcccatataggaatttttgcggttcagatttcggtaattctgtttttccggcccttgtcctttcccgttgctgtccgttgttcccggcagtctcaccagatcagacagttctttcagataccacgcatcccggattcccctgcgttccggatccagagagaatttccagtttccatttaataaaacagtatttatatttctattctctgtcataatatcactccgtttcccgtaggaaagcctcctgccggcggcaggaggctttatgaactgcctgtaagccagtctgcctgaaaactcaccaattcattattccattgttttaactttttcctttgcctgatcccattcatttgcataccaatcatgtactttatcaatacccagagaacggaattcttccatcgtctttgtcttgagatctgccagttcttcatctgacccggccagaatcatctttgccgccgccttcagagacgcttcatcaagtttggcttccattcgtttaatatcatcgggaggcgtaggaaccagtgccagcagcaggctgttggccttactctgatcataaactccgtatttctcacgatactgttcaaaaatttccgaaggataacttactttataatgatcacagtattccttctgcagctcattcaacatggatggatacatggtttcgtcacggaacagattcactggttttccatcttcgggatcaattacattctgccccaatcccataaagttcacatcaaaaccgataccgctctcctgccatgcctcgccgccggccttctgcaaatccagcgtttcctgcttcatcacaggcttaccatccacaagatcccagtccacgccttctacaccgctgtaaagtgtacgcgccccatcgtaggagtagcaatagtttaaaaaggccaccgctgcctccggatatttacaggtagaggaaataccaatagacttatcaatccaacctaccttataatccattccataccactgatttccccatttcataggaagagccatgaagccctgggtagtccctgcatgatccttattaaaggaaccggctccccaggttgcaggcgccgtcaatacctgtcctgctgtaattttcgcctgcagatcttcatacttctgggtcaatgtatccggatccagaataccaagctgattggctttatagtagtaatctatggaatcccagtataatccgccttcatccaggctcagtgcaaattcattggtatccacatgatactgccccagtgtagatccgctgatgctgttatatcccataaatgccgacataggctgtaccaaataccagtttccccaatccgcaaacatagaaatcgcatataccttttttccatcctctgtagtcggatgtgcgtcctgcatttccttaagcatctgcagatattcatcaatattgttagtctccggatatcccagttccttataataatcccatctcactacaggccctattgcgtgttctatttccgccgtatccggtcctacctgtacaggaagaaaatacagcttattttccccgttgctccaatacttgcggctgaaggcaaccgtatccggtgcattagccaaaatatccttaccatattcttccagataatcatccagcggcagtacatttttacccgctaccagctgttcaaaattgtccggccccgtcctgaccaaatcaggaagatccccgccggcaagcagaacattaaacttgtcattgtccgcgtttaccatatgaattcgaacgccgatatcttctgccattttatcctgtacatgattatccgcatactgattaaaggattctcccacattctttgccagaatatccagggttacttcctggccgcccgatgcatctttttccatatccgtttcagcagtctgcgcggcctgtgtctcctttccttccgtttccccgcctgtctgtaccggctcctttcccgacgcaccacacgccgccatcgtcagcagaagaccagccgctgacaataatgcaataaactgttgctttttccttcccataaaaataccctccttctccgacatgaacgccttcttttatgcgcacatgtctatccttttaccgctcccaacataatcccctttacaaagtgcttctgcatcagaggataaataaagagaatcggcattgttaccaccatagtaattgtcattcttaccgcttccggcgtaatctgaaccataattccctgatttcgttccgtattactcattgtagcaatagcactggcctcattcagatattcataaagcataagctgcagagttttcagatgatctgaggataccagaatataattgtcaaaccagttattccattgggccactgccgcaaatacagtaatcgtggctacaatcggcttggataaggggaaaacaattttactgaaaatctgaagatatcccgctccatccagctttgcggattcttccagggactcgggcagctgctcaataaaggttttaagcagaacaatataataagctgaaatagctgtggggagtacatataccagaaaggtattattcagatgataaagcttcatcgtcaaataccatggaatcaggccggagctgaaatacatggtcactaccaccattcggtatattattttcctcccatacattttttcttttgtaaccagatatgcaaataatgaacagcacataatcgtgataaccgtcccgattaatgtccgcatacaggaaatcagcagcgcattggggattcccgccagccggaatacctgcgcaaaattacttaaggtaaattcccttgggaaaaaagtaatccctttttgggccgccgacggcgtgcttatagaataaataaatacataataaaacggatacacacacaggagcattacaagaaacatcacgatatgatccactacataaaaaatcacatctccggccgacaccttttttcttttcattcccgtttttcctccctgcattcgttctccagtcagacaatgccaaatccacgtattttctttgacagcccgttaatggaaaaaagaagtgttacactgacaattgttttcaaaattcctactgttgtagcataggaataatcatttgtaatcaaaccgagacggtatacataataatcaatgacttcaatcttgtccgcaaccatgctgttatgaaataccagatactgatccaatcccaccgacaggatattactggcggataacagcagaagaacgataaaggtggaagaaattcccggaatcgtaatatgcagaattttctgaaatctgccggccccgtccacacttgccgcgtcaaacagttctccgtcaatccccgctattgcggcaaaataaataatagcgttccaacccagggacttccatatccccaacgctgtttgaaagtaccaaacagcatcctcattggccagtatattggaaggctcagacagaatccccagcttcattgctacctggttaaaaactccccctgtggaaaaaatattaaaggccagcgaatatacaataatccagctgacaaaattgggaattgttgtagtagtctgtaccagcttgcggattctggctgatggtatttctgtaagcaaaatagcaaaaatagcaggcaggggggcgcacaggataccaaggaagctcattaccagtgtattacgaaggacacgggctaaagtactccagtcttctactaaaatatgaaaatacttcagccccacaaagggtgactgcgataaaggtattcccggtttatagtcaataaaagcatatagccatccaaataacggtacatagaaaaaagcaatgacaatcattacaaacggcaatgccagcagcagcagcttcattccatccttcttgaatatattagtctttcctggtgactgctccttcctaactctctttgtttcttccttttctctttttcccacttgcgtttcacctcctgttattttattctatgttttcttttaccagctgtaaatgtaaataacactgtttaatcagcactatttacggttccaatcttatattcatgtaatttttactgattatttagtaattatcacggtttttttattattttattgattgatggtatactttctgcaataattaaaatcaaatgttatattgcagacagatcactgcaaaattccgagagcgtttcctatcagagaagccaccttatagataagaaatatgcctctcctgagtattgcccgctaaaaaaaggaaaagaatttgaaattcaccagatataggaggggacaatatgtataaagccatgatcgttgaagatgaaatgttggtgcgtatcggcatccgtaatgttattaaatgggaaactcttggaatacagctcaccgaagatgcggaaaacggtgcaagagccctggaaatttaccgttcagagcatcctgacatcgttcttaccgatctgcgtatgcctgaaatggacggtatgtccctcatccgttatatacgaaagcaggataaaagatgccgttttcttatccttacctgtgtggaagactttgaacaggcacaggaggcgattgcttacagtgtttccggttatctgcttaagctcaccatggactttgatgaagtggaaaaaatgcttcagaaggctgtggaagaactgtctgttcttccgggagggccaacctatgccggtattgccaacctgtcgaatgtaaaagaaagggttctgaaagatcttcttactatacaaggctgttattcgcaggatgccttcagagaatatacaaatacctgtcagcttcatttaaaagaagaaaacctgattgtgggtattctttctctcacttcgtccaaagagaaattggtacaaagctctattctgaatgttcttcaggaatttttggacggagatattaacggagaagtattttatgatacagaatctgattatattctgctgctgaatctgcctgaagcgtctgagagcaggcagagattacttgatttttattccagaattagtgaaattatgaaaatgtattttggagtccatttttccttaaacttcagtggcttctgtaatggatatgcagatctgccaaatcggtatcaggaggccagaagacagagttttttcaatccttcctctcctttcgcccagtcagaagccgaacacctcctcctgcttaaggaaaatatacaaagactggcctgtaacccacttctgtttgcactgtttgattcccctgaccgaagcgaatatctccgacagctggaaggcatcagcaatactcttcccacacagtcccagatctgtggtttttacatcaacctgactcgattcagtgcctatactgtaagccaccagcgccatatcggcaaactggagatactcgaagagtgtgtggaacaaatgcagcggcggaaatttcttcaggactttaccaatgaccatcttgaatatctgcagcttttgtgggaacaaatctgcgaggccggccgttattctcctgaaatcgccctggcaatagcttatatccgcaaaaattgtatggaagggctttccctgaatcagctggcagattatgttcatttgagtcccaattatctcagcaacctattcaaaaaggaagtcggataccggttgagtgattatgtgaacgagctgcgtattgaaaaggcaaaatatcttctccttaatacacgagaacgttctcacgaaattgcttcggagctgggattttcggatcccgcctatttctgcaaggtttttaaaaaatctacaggtctttcaccagcagaataccgacatatgcatacaaacagatagggggtacgaatgaaaaaaaagagaaggctgtttacccatctaaatatccagatggctgctttttttcttgctgccaactttatctttctgctcattgcctccgcactgtattaccagtgggcatttcatatcctcttagaagatggcgaaaaactgcatattcaatctatgcagcagtcaaagcatcgaattgagcagacacttgaagaagcagataaagcggtaagcctgctgatttacgggaatatcggtcaaaaaacgctggctcattccggcgataaaacagatatcgacagcattttgctttaccgcagctacttagaccaggtcagcggtatcctgcgcagttattcctccatttattccatctacttttatacaagcgataacctgttaattggctccagcccgcttcatacctgtattaatgatgatcctgcctccattccttcccttctgaaatatgtagggaaaaataacagttgggggatcattggtggattaagggaagatttttttaatcctttattcaataaggatgaagtaaatccccgtctgatcaccatgatcagacgttcccctgtatttcacagcggggtaatttatggatatattatcgttaattttcaggaagaccgattctatgatgccttccaggctgaacttccgggtgaagaactgctccttcttacttccgacggaatgatcatttcaggaaatagaaaaaaccggattggagaattagataccggttttcaggctcataaaaatgaatataccagtaagattacttatgaaaaacatattcctattctgaatctgagcattcctatttctgatacgggactatttctggttaacagaattcgtctggaggaactgatggccggacgccgtgagatcatcataaaaatcatagccaccctgatcctggaaagtctctgtatgctggtagtcgtcagtctgtggctgcgcatcaagctctatcctataaaagaactgaccggaaaaatggatgaaataaaaaacggatgcttcactcctcctcttaaaaaagttccggaaaatgaactggggattctggtagaaagctttaatcagatgtctatttctattgtggagcttatggacaaaaacgagcagatatacagacagaaaacagagcaggagcttcaggccttacgggcccagctcaatccacactttatttacaacacgcttaacaccattaaatggatggctgtcatggaaaacgcggataatattacagaatgtatcacggccctgggctgcctgctggaacctatttttaaatccgatggccagctatggcaggtgggtaatgagattgattatcttcagaattatatcaagatcatgggctggcgctatgggaacacctgcagattttgctgtcatattacggatacctgcagagaatttctgattccccggtttatcctgcagcctattattgaaaattccactactcatgggatacgcaaggataagtccattcagattgatattacctgccgggaagaaaaatgccggcttctgctctgtgttcatgacaatggcaatatcagccccgaaagacttcaaaagatcctgctgtctctggacagccctgcccccgcgccgtccataggcgtaggcctgtttaacgtcaaccgaaggattaagctgaattttggagaagaatacggcctgcatattaccagcagtccctggcttggaacagaagtcacactgacccttcccatcattacaaaggaggaacctaatgaaacatcctaacattgtactttttctggcagaggatctggattttgaaggactcaactgctataacccggagacaaccggatataccgggctgatccgggcccggaatcccttcgcctcatcaacacaaaaaccgaccggccggcttctgactcctgctattgattctatggcaggcgatggagtgatgtttaccaattattattgcacctctcctatttgtactcccgccaggtatacggttatgacggggcgtttcccggaacgcagtccggagcacggggagatctttggaaatggcccttctaccgtgtggtttaacagtcccgtatgtcccggggaaacccttattcccaaggcactgaaaacagcaggctatcaaaccgccatattcggaaaatggcataattatccccttcctgtaagaaatgaattaaatcgtctctatcacgcctttccagaggaagcttcctgggaggatccggaagttaaaaagcgtgttcatgaaggctatcaatacgctgtagattatttaaaaaataatgactatggatgggataccgttgatcgtatttattatgaaaatcctgaaccctaccttccggtttccatcagcagccataatatcgattgggttatagaaggggctgatgactatatccgcagccgcaccggacagactgatcctttcttcgcatatatcgccgtatccattccgcattcccgttattcgggtaagcgattccgggaagcgaatcccctttcttcacctgccggattgctggacaggccgccgcatgtactgccgcccagacatcaaatccgtgaaagaatactgacagccggaatggccgaaagtgcatgtgaggggctttggctggatgaagcggtaaaagcgatccgtaatgcaattgatgctattggagctaccgaagatacctgttttatctttacgacggatcatccgactgccggcaaagggagctgccatctgggcagaatccctttaatcatgttttggcctcatcatttggagggtggcggaaccctttctcatttgctctcagagaccgacctggctcccactattcttgaacttgccggctgtaatgtccctcctgatatgcgtctcgacggacacagttttgccggcctgctgcagccgcatatttccagctggacgccgcgcagtaatgtccttatggaaaacgtaaattccagggccgtcattcaggatggttacaaatatattgcaaatcgtctgcccggacggaatgctttggaatcagagctttgcggccgtacgggatggctggccgaacaaataggcgggcacgacggaatatggtggaatctggatctcctctttccagcctattttgatgaagatcagctttataatatagagatggatcccatggaacagcataatctcgcttcagatcccaaaaacagaacgcttcttcattccatgcaaacgactctgtcacaggaactaaggaagcttccccatccttttggcgaatttagctgataagaaaattatgttttattttatatctctcatttattaacaccggaatagaagaaggcgggtcccccgccttcctcactcccttcccccaatcctgaccgccgcataataaatcccatacaccagtacaaaaaatcccaatgccgtccccatcgcctgccatatccaaaactcacccgaaaaaacaggcatccccggtgcatcaaatacgattctccgcgctccgtcataaatcagccaaccgccgattataagcgccggcggaaccggaagcagaaagagcagcagcaattgccggttatttaatctgtttatcatcttttcattcatccccagctgcccaagtatcctgttctgccgtttctttttatcgccgtcgctgagtgcctgtgttgccagaaccgccgttcccgcaatttccagaatgacagacagatataccaggcagatcaatatcacataaatctgtgacagagaatccttctgcacccatttcccggaaagataatctttatccgtatatattaaagaagtaaccgcaaccccattctccgtctcaaccgattttccaacccctctgtccaacagaacaagcctctcaccttccgtcagctgcctgagctccataccgttcagcggaacctctgtaatgaccgcataaagactgtaaagcagctccattccctccgctgtttcgtccggaatcacaagaatataatccaggccgtttccataagtgtcattctgactgaaggattctgaaaaaatctttcccatcatcaggctctgcccgtttatctccagttttccggctttctccatataatcctcaaattcatcagcaagctgcggaatgcaatggacataacaggaattcttgtccagctccggctcctcgtatcccagcatatgtctcagataaagataatcactctgtttcatataattatcatattggaattccgcacgcggagtcatacgaaccttcttcctctcctccacttcattttcccaaaccgtataaaattccctgcttctcccggtataaattccatagacatgcgccgacttcacgggaaacctttctgaaattctttcttcatacgatgaaaaatccgtcatttccccttcatgcagaatcaatatatcaaacacattcaatccaatactttgatctgcaaaatggccggcagctgatgcgattcccaaaaaggtaatggaaagggtaaacaaaacagacaatgtccccagcaccacactcatggaacggatctttgaagtaaagccccggaagactgtcagacggtttttccgatatgtccagcctttccgtttttcaagcctctccgacaaaaaagaagggacactgaaaaagaatgcaaacagcccgatgaccagaaagaccagccctgtaagaagatcgaatcctctgccgatgggccgtatcacaataagcgcataacctgcagtaaaaaggagcagtgacagcaaaaatatccccgtgaaaaatggtttccggcacggatggctgctttcagtctgtctgtcataatacagcaaatcgtacagccgtattttataaatccttttcttacttttatgcagggcagacaaatacatggctgcaaaatacaacagtgtcagtccggccgttttaaatgagacggaaaaacccagcgtaaatgtcatcccgaacattttaagcaccgcggattctaccagccaggacaggagaatccccgccggaaggcctgcgatgaaggccgtgcccgcaataatcaggttctcatacaaaaacagcccggctatcgtcctggcggaaagccctgaaaccatatacagactcagttctctgcttcgtcttttcagcatatagccggtcatataacttacaagccagcccatcaccagtataatgagcagagtaaccgctatgatcatataaggcagcacttccagctccggaagaagtctgaccttatctgaaaaaagcagggcattatacgcatacatacacgccacagcgcaggcaattgtaatacaatacagcacataatcccccagctgcctttttgcattgcgcagtatcagctttttcagcatatgccttcacctcctaaaagagaaagcacatccagaatttcatgatagaaaacgcttcttgtcttttcccccttccggatttcattgaatatttttccatccttcagaaacagaatgcgatctgcatagctcgagcagaacgcatcatgggtaaccataaaaatagtcgtacccatatccttattcagctgtgcaatgatttccagcagaacacgggaggaatgggagtccagcgctcccgtcggttcatctgccataatcattttcggacggcaaatcacggcccgtgcaaaggcacagcgctgtttctgccctccggaaacctgatacggaaatttttccaggacatcactgatatgaagcttatccgcagtatccctgactctcttgtcgatttcctccggatccagtcccttaattgtcagaggaagagccacgttttcttccagagtcagtgtatccagcagattatattcctgaaaaacaaagccaaggttatcccgtctgaattcggcaatctcattttcccggatgtccgtaatatccctcccgtccagaataatgtgcccggcgctcactgcatcaattgtggaaaggcagttcagcagagtggttttcccggaacctgacgcgcccataatgctgatatattcaccttctcttacatgaaagctcagctgattaagagcctttgtcacgctcccctggttaccataatatttttcgatattctccacctgaaggagtatcttatttccaccacccaacttactccaccacctttccgttttcgataacaacatccctgtcttcaaatttcaatacatatttgaaattcacatcttcggcagaatcaatatcaattttataggttcccttcctgtttaaggaaaattcagcagaaaatgtgtatatcctggtttccgataccgtatttccctgagaatccctgacaatatcctccgtcacctccggaattataaaacaataaggaaaacggccttcgatttttacctgcaccacccgttccccttcccaaatccattccacacccggcgaatcagatttaattgcccataaggagggcacatagaacctgtcatccgttatatgcctgattccgtacatagaaatgacagctatgatcagaccagcaagtaaagccgccgcagttttggccgtcttcccccttcttttccttcccttcccgtatttattttccataatggacgcctccttcccgatttcctcttcattttaccgggaggctccgcttcgttgtatatatgtttcctgattttatataacagatttgtaagattcctcccggctggatggagcactagaccttcaggtgcccgcttttcggaaagctaagacggagcgttgtatactgcccctgctctgactgtgcttcaatggaaatccccagcttgaggcacagctgcctgcaaagatacaatccgattccggtcgctccctttccggctcttccattgcttcccacaaatcctttatcaaatatcctgtcgatctcgctctccttaatacccgccccgttatccgtgaccgccaggacaacatatcctcccatatccgtggattccacagcaatcacaggaggtcttccgccgctgtatttcacgctgttgatgataatctggttcattatgaacactacccatttttcgtcggaatataccgtatccctgaccttctccgtgctcacgctgaccccgttctgtatcaggaactgcttgttcgccgcaagcgcttccatgacgcagtctctcagggacagttctttgataaaatagtctttttccacattccccagccttgcataaaacagcacccgctccacataccggccgatctgctcggtctgtgacatgattttacggatcgtgtctgatttgttattttcacacagaagctgtattcctgtaatcggtatcttgatttcatgaatccactgctcaataaaatccctgtattcctcatttagccgcttcgcctgtgaaacctcatccgtcatggatttaagcgcttcttttatcattcggaaatatactttttctgcggatgataccggtttttttgcaacctccgccatgaggtatttcctatccagggaatccagcagtgactgcagatacagcagcctcttcttaagtatgacataacctctgcacaaactgcccgaaacaatccccgcatagcatatccagagcagaaacatttcctggggtgcaatgccataaagatacagcagcaccgaaaagaaaagtcctcccgccagacaggtgagcagtaccgctcttttatcagataaataatcggaaagcgtcatattttatatcccatccctctttttgtctgtatcagattttctgcgccaagtccgctgagcttttcccggattctcatgatattcacactcagcgtattatcatcaatatgaatctgattatcccacaaaaattccaccagatccattctcgatactatttcccccgtatggctgaacagataatatatgattttcagttccgtttttgtcagttcagtctcctggcctttgaaagaaagcgttcctgacaccaggttcagacgaatccccttatattccagccgttccgcctgccctcccgcttttccccttttcagaagaagtctgatcctggcgagcagtatcggaacattatacggtttgctgacataatcatcccctccgaccgtaagcgcatacaattcatccatagatgtgtcacggcctgttataaacataatcggcgtatcggtaaagctccggatatcagcgcacagacggtatccgtccctgtccggcaggttaatatccagcagaattaaatccggacaaaaggattttaccaaatcagttacatgatggaattcagcggcgctttccacccggtatccctcattggataaaaggatttccagttcctcccttatcaggtcctcatcctcaattatcagtatttttcccatgcaggccttctcctcatatgtctttctttctatatttatacagtctcaacacaagtatagcattatctgtgacggaacaaaataatacataaacaaaacaagattatacattttaatttcctcccaatcccctaatatagaatggaacttataactgttcagcagctttgtatatttaattttttatatcatccgggaggggatatccaaatgacacctatgaaatggttctattcttttattaagccttaccgaaaacggctctttctgggattgtttctcgtaacatttctggcagggctggccatcattaaccctatcgtcagcggaaaagtagtagatgatgttatcagcggcgggcagtacgacaagcttcccctgtttgttttcatactgcttctggtaactgcaatacgaagtgtcctccgcttcatggttccttacaatttcgaaatttgttcccagggcgtactctacaaaatgagggatgcggtgtaccgcaagctcctgatggaagactttgcattctataaccgcaaccggaccggtgacctgatgagccgccagacgggtgatatggatgccatccgccactttgtggccaatgtaatttcttccatttatgaaaatatcctttattttggttttgctctgattatgatttttaccatcaacaccaaactggccttatgcatgctctgcatcctcccctttacggtggtgctgaccgtctgtcagtttaaacgggtaaaacctgctttccacaacatccgtacccgcttctccagcctgaacacttttgtccaggaaaacatcagcggcaaccgggttgtgaaggcctttgccaaagaagattatgaaacagaaaaatttgaagcggaaaacgatgcctataaggcagccgaactggactgtgcggctatctggtccaaatatgtccctgtttttgaatttttctccaatatcctcaccgttgtgctcatgctctacggcggaatcatggctatccggggtgaaatctccttaggaagccttgttaccgtaaacggttacctctggatgctgaatatgcctctgcgtatggcaggctggtttgtaaacgatgttcagcgtttcgtgacctccgtggaaaagatccacactaccttttccgaggagccccatatcagcaaacctgataatgccattaccaaaaagcactacaaaggaagcatcgaattcaggaatgtctcctatcaggccgaaggcgaggatattatacaggatgtgagctttacggtgaagcccggccagacaataggtattctcggccctacgggagccggaaaatccaccatcatgaacctgctgtgccgtttttatgacacaactgcgggcgatgtacttgtggacggcgtcaacgtaaaggatctggatttgtatgagctgcgagacaatatcggcatggccatgcaggatgttttcctcttttccgacaccattgagggaaatatcgcttatgcccgtcccgattgtccgtttgaaaaagtaaaaaaagcggccatcgccgctgatgccaaccattttatccaggctatgcctgaaggttatgacaccattgtcggggaacggggcgtcggcctctccggcggccagaagcagcgtatctccctggcccgcgccctgcttaaggatccgtccatcctcatcctggatgacaccacctccgctgtggatatggaaacggaaacctacatacagacacagctgaaaaacctggaaggcaaccataccatcttcatcatcgcctaccgtatatcctctttgaaggatgccgatcagattctggtactggatcacggacggatcgcggaacggggaacccatgaagagctgcttaaaaacaacggctactacgccagagtatttgagcatcagtatcatacaccggcaaaggagggacgttaatatggcacgtaacagatacgatatagacgaagtcatggaagaccattttgaccttgggcagctgaaacgtctcggccactatgtccttcccttcaaaaaggatatgttcctggcggcgtttctcatgctctccgccagtgcgctcaccatgctcatcccccgctttttcatgacagtcatgaacgacatcattcctgcgggagatatcaggggactgttcctcatcagcttctacacgctgctgattatactgtattcagtcgtctccctgaaagccaagatcaaaatcaccaaccgggttggccagtccgtcatccaccagctgcggaccgatattttctgccatctgcaggagcttcctttctcctactacgatgacaaaccccatggaaaaatccaggtaagggtagtaaactatgtcaataacctgagcgacctgctttccaatggtcttctcaataccataacggacctgtgcagccttatatttatcatctttttcatgctttccatcaatgttaagctgaccttgatgtgtatgtgcggcctccctgtcctggctatttttgccagtcttattaagaaaaaacagcaccgcgcctggcagatccagagcaataagcagtccaacctgaatgcctacatcgcagaaagcattaatggcatccgggtaacccagtccttcgtaagggaaaatgaaaacagcggtattttcaacaatctcagcgacggctaccgccagtcctggatgcatgcggtacgcttcaactttatgatggggcccaccgtggatgttatttccgctgtaaccactgctttcctgtatgtggctatcgtaaatatggccatgaacggcggaaccgcttccgtaggtgtcctggtagcctttaccggttacatcagccggttctggtcacctatcaccacactggcaaacttttacaattccctgctgactgcgatttcctacctggaacgtatttttgaaaccattgacgagcccgttgccgtaaaagatgagccggacgccgtggaaatgcctcccatcacaggaaaggttacctttgatcatgtatccttttcctacgaggaaggctataaaaccctggatgatgtaagcttcaccgccatgcccggcgagtcctttgccattgtaggccctaccggcgccggcaaaaccaccatcgtcaacctgctcagccgattctacaacatcggcagcggcactatccggattgatgataccgatatatccaaggtcactcttcattccctgcgtacccagatgggtgttatgatgcaggacagctttatcttttccggcaccatcatggataacatccgttacggaaaccgtaccgccacggatgaagaggttatccgtgccgccaaaaccgtttgtgcccatgacttcatcatgcagatggaggatggctaccatacccaggtaaatgaaagaggaagccgcctgtccgccggacagcgacagctgatttccttcgcccgtgccctgctggccgatcccaaaatcctgatactggatgaagcgacctccagcatcgatacggagacagaaatcatcctgcagaaaggcctgaacgagcttcttaaaggacgtacctcctttatcatcgcccaccgcctttccaccatccagaactgtacccgcatcctctacgtggataaaggcaaaatacaggaaagcggcagccatgaagagcttcttaaaaaccatggcccctactacaacctgtttatgtcccaatacagctttatgaacgacaaggtccaggatgatttcccgaaagagaacttcccggaagcctcttatacctgataccgtccactacatcatttcccgtaatccggatgcgtttctataatgacaagccggattctgcggttatgaaaaccggcctcactgaaagtcccctttactttcagcgaggccggctctttttacagcttccttcttctgcccatccaaatcactttacaccaatctccctattccttcggaatatattccagcagattaatatccgcctcctcctttcccgaagaaacatacaaaaccagctcactccagcttccttcctccaccggaaaagaatacaccctccccttctcccagcttcccgcttccgactcctcatccagataatgcacgctcataccgccgccctccgtctccagccgtccgctgatctgaatataccaggaactatcatactcctccggaaccgtaaaatgcaccatcccttccgaataccccacactcttctccagcttctccaaaggcgagcttttcatgagcccttccctgaccaaaatcaccccaaggacacataataatacaactcccagaacaattataccttttctataccttaccactcttccttcccccctcttttcaaagactccagcacctcaatcaactcgtcccaattgttaagcgtcaaataatcaaccccatccggcgcctcctgccccttcttcgcatagggagtataccataccgccttcatccctgcccccgcggcccccttcacatcacaaaaaagattatcgccgcaataccatatcctgtccgccggaacccccgccttaacctgcgccattgcaaagatcctcggatgaggcttcctgaacagataatcacacgaagtcataacaaaagaaaaatgattccccggaagaagcccatctatcttttccttgagactctgtgtactcttcatcatattactcaccacagccgtcccgatcccctccctgtaaagataatccagaagcttctccacattttccgtaaccctcaccctggcggcccctttccagaataccctctccacctcctcccagggaattccaagttctatttccagatactcatacaaataccgatcaaacgaaacagcagaaaactccccctccgccttccctctcttttcctccccaaaaagcccttccatatctcccgtcagttcatccgcaaactcctgaagctgctccgccgtaatcccccgcggatttttcaccgccatactcaacacagcccggttccccctgaccgcatcataatccccctcatccgccaaagtctgcccataatcaaaaatcaccatttccggcaccattcccatcctatttccctcctatattcatccatttcaacccaaccccttacccccattatacttcccccaacttacaatacgcaactctcccctctttttatcttttactcttttatcttttactatttccccctataatagatatagcattttacggatttcaccatccgattataagccgcccaggcggcagaatgagaggtaatcacatgaaccagctttatatggaccggctggcccgggtatgcagcaggctccgggagcagggcctgacacaaatgatagtaagcgatcctttaagcatcggataccttaccggcgtatggattgagccctacgaacggctttttgccttctacatccgcaccgacgggaaacacatcttctttctgaacaatcttttcgtcattccggacattgacgtaactaaagtctggatgtccgatacggacgactgcatcggcatcgtggcttcccatgtggacgccggatccgatatagggattgataaaagctggcctgcgcgctttcttctcgacctgatggaacgcaatcccggagtacgttatgtaaactcctccgcgtgtgtggaccgggtacgctccatcaaggatgaatatgaaaaggaaaaaatgagagaatcctcccgcattaatgacgcctgtatggaaaaagccgccgcttttgtcaaagaagggatgacggaaaaggaatgtgcggattatatccgttccctttataaggaagagggctgcgaggaaggctttgaaaccattatttccttcggggccaacgctgcggatccccatcatgaaccggatgacactgttttaaaggccggggactgtattgtcatcgacatgggctgtaggaaggacggctactgctccgacatgacccgtacctttttctgcagaaaggaagaccccgagtatgcgcccattcatgatttggtcagaagcgccaatgaaaaggcggaaagcctgatccgccccggcgtacgattctgtgatctggacaaggccgccagagatctcatcacagaagcaggctacggggaatatttcaaccatcgtctgggccattccatcgggatgcaggatcatgaacccggagacgtgagcctggctaataccgctgtagtggaagaaggcatgaccttttccatagagccgggagtttatcttcccggaaaattcggcgtgcgcgttgaggatctggttctcgtcacacaagacggctgtgaagtcctcaataaagtggataaacactggaaaaacatcggctgatgggccggcaggctgcagacggatccgtccgtaataggaaaagcatgaaaatcgcaaggatttatcccgggaaaaatcgtccatagtatgctaaaatattgatattctatttttataactactcagggaggaatatcaaattatggacaaaacatatatttcaccgcatgaacgactgaaaaagtatgctttggaggatatttcctctgtttatgaggattttcatctgtctcaggacgggctgaatgaagcccagatctttcagatgcggaataaatacggcagtaatcagattggttatgcggtgaagaactcttttctgcaccacctcaaaagagcatttgtcaatcccttcagcattatcctgtttgtccttgctgccgtttcttttattacggacgtctgcctgcagtccaattacggacgcaacggcaccaccgttattatcattctgtccatgctcctgctcagcgggaccgtgcgcctgcttcaggagctcaaggccggccatgccgccgatcttctgacggaaaaaatactgactaccgtcactgtccgccgtgagggacaaatcatggaagttccttcagaggagcttgttgtcggcgacattgtccaactttctgccggcgatcgggttcctgcggatatccgtctgagccgtaccgatgatctatttgtttcccaatccctgctgacaggcgaaagcactattctggaaaagaacgcggagcaccttaacccgatgactcatacctccctgaacagcttttccaatcttgccttcatgggaaccattgtcatcagcggttccggggaaggaattgttctggcggccgggattaatacggtatacggtagctatctctatgagcttcagcagacaaagcggggcttcgaacagggggtcaattccatcgcatgggtgctgatccgttttatggcggcgctcatccctttcgtgtttgtaatatccggcatcacaaaaggcgactggctgacttcttttcttttttccctgtccgtagctgtcggcctgacgccggagcttcttcccatggtcgttaatgcctgtcttgcaaaaggcagtaccgccatgggcaaaaagcagaccattgtaaaaaatatcaacgccatgcagagcttcggcagcatggatattctttgtgtggataaaaccggaaccctgaccggtgatgaggttcttctggaatattacctggatatactcggtgatgaacgtcaggatgtattggactgtgcctatctgaacagtttctatcataccggcgtaacaaaccatctggaccgggcggttttaaaatgctcctccatgccgggaaaagaggaatatttcaggagcctgccggaaaaagcagaaaagctggatgaactgcccttcgattatgacaggaaatgtgtcagtatccttttatctgttcaggataaaggcaattatatcattacaaagggggacgtggacagcgtttattcacgatgccgctatgtatgccaccatgatcaggtgattgaagtggatccctccgattccggcggcgtgcatgcggttgtcgatgaaatgcttgaggatggcatgaaggtactggcggtcgcctgtaagcccgcgcccggtcagtccctcctttatccggaggatgaaaaggacttaattctgttaggatatgttgtcttcttcgatgctcccaaaagttcagccgccagtgcattggataagcttcagcagctccatgttcatgtaaaggtgctgacaggggatcagaaaagcgtggctgtctctatctgcaggcgtcttggcatcccgacagacctcgctctcaccggagaggaaatcgagatcctgacagaggatgagttaatcacctccgtagaacaggcctcgattttcgccgaactgactcccagccataaatcgcagatcatacaggtactgcgtgaaaacggccattccgtcggatttcttggcgatggaatgaacgatctttccgccatgaccgcggctgatgtgggcatctctgttgacacggcagctgaagccgccaaagagtccgcggatgtcattctgctgaaaaaggatctgaatgtactggaacaggggataatggaaggcaggaaggcgtttgccaacatgtccaaatatatccggatcacggcatcctccaatttcggaaacatcctttccattgtactcgccggcgcttttctgcccttccttccgatgactgccgtccagctgcttctgctgaacctgctttacgatattctgtgtatgacgctgccatgggacaacgtcgatgcggatatttatgataaacctaatgtctggtcgggaaaaacactgggccggttcatgcggttcttcgggcctttaagttcgctgtttgatcttattacctttgcctttttatattattttttatgtccggcgctgacaggagggctgtttccggagctgtcccccgccatgcaggagcaatatgccatcctgttccataccggctggtttttggaatccctctggactcaggtgctcattctgcacatgctgcgcaccaaacaccttccgttcgcgcagagcagtgcttccggcatcgtctggctggtgacctccgcaggccttctgctgctgactgcagttgtctatctgccggcggcgtcatggcttgggctcgcgcctctgcctttatactattttgcatttcttgcggcagttgtcctcgcttacatgctgcttgtgacccttgccaaacagtggtatatcaaaaaataccacgagctgttataaaggagggataccatgaaaaaaatcaactttgtagcattggattcctccaccttgcaatggctcaggcaggttcttttagaaaggagaacagaaagtgaagccgcggccgaattataccgcggagtggaagaactcatctccggtcagctggactctctcatgctggaaccgggcagcagcgtgtccgtcctggccaatgacggactgacctgcggggatctcaccatacatgccaggagccgccaggtactccggggaggaaaagaaatccagctgacgccaaaagaattcgacattctttatttcctggcccgaaaccggggcattgtctttaccaaagagcagatataccaggccatatgggaagaggattattataccacggacagcaacatcatggcctttatccggaagctccgcaagaaaatagagcctaacccggatgcgccggaatacattcttactatttggggaatcggctataaattcaatgataaattataaagaaactctcagaagcaattggttttttaaaatcaattgctttttttcttgccggaaagcaagaaaatcgcaagggttcagccatgggattacggcggaaaaccttctatactttggtttgtaaaggaaagcgaggtgattttcatgggatatttgaattaattctccggattgggctgtccatcctgccgggcttttttatcggtctggaacgccagataacagggcatcccgccggccgttccaaggcccagacagcagaatctattgtaagcaggctcctgacggtacccagtgttgtcagagccggctgggagcttctataggaggaaaaccatatgaattttacctgtcttatactcggcattctctttgccgcagcaggaatctttttttattccggcagggctgttaaccacattgcggcctggaagtcaatgtccgaagacgaaaaaaggaaaatacggatcggaccgctctgccggaatgtggggactatgattttcataagcggcattatctttatgctcagcgggttatggaaagccttccgcggtgatgtattcctgtggagcatgatcgcctggctgatcctttcagggcttgacgtctattggattggaaaatccggcagatatcaaatcccggaataaaaaactttactattaaacaaaaggaggtatcaacaccaatgaatcagaaagaaaagaaccgcgtaatggttcataaaacaacagcggaaatggtccgcagggatgaagcgaataagaagctgatttttgcggcctccaacaaaatcaagcccgtgctgaagcagcttgattccacgcttacgggcctggatgaaaacgcagtggcttcccaccgttccatgtatggaagaaacaaggttacccatgaaaagaaaaagtcccttccggcacgtctcgcgggcgcttttatcaaccctttcaccgcgatactgttctgcctggcaatcgtgtcgattttcacggatatccttgttcctgtttatcagcaaatgccggaagaagtgtcgccgctgaccgtcatcatcattatgacaatggtattcatttccggaacactgcgctttgtgcaggaatcccgctccgggaatgcggctgaaaaactgctggcaatgattaccaccacctgtaccgtcacccgtaaagacggcacaaaggaaattccgctggatgaactggttgtcggcgacatcatccacctttccgcaggcgatatggttcctgccgatgtgagagtcctggaagcaaaggatctgttcatcagccagtcggcgctgaccggggaaagcaatcctatcgaaaaaattccggtagtctgtgagcaggaatgtgaaacagttaccgattatacaaatatcgccttcatgggaagcaatgttatcagcggaagtgccacagccgtcgtgatttccgtaggtgatgacaccttgttcggatccatggctatttccgtagcaggtgaagctgtggagaccaacttcaccaaaggggttaacgccgtttcctgggtattaatccgtttcatgctggtcatggttcccgtcgtatttttcatcaacggccttacgaagggcgactggcttgaggctttcctgttcgccatctctgttgcagtcggcctcactcccgagatgctgccgatgatcgtaactacctgtctggcgaagggagccgtatccatgtccaggaaaaaagctatcgtaaagaatctgaattccattcagaatttcggggccatggatgtgctctgcacggataagacgggaacgctgactcaggataaggttgtcctggaatatcatatggatatcgccggaaaggaagatatccgcgttctgcggcacgcttacctgaacagctatttccagaccggctataagaacctgatggatgtggccattattgaccggacggaagaggaagaggctgcgaatccacagctggcggatctttcggagatttaccataaggtagatgagattccctttgatttctcacgccgccgtctgtccacagtcgttgaggataaaaacggaaaacggcagatgatcacaaagggggccgtggatgaaatgctttctgtctgctcttttgcagagtataaagagcagatacagccgcttacggatgatatccgcaaggaaatcatggccacagtcgattctctgaatgaaaacggcatgcgtgtcattgcaattgcccaaaaagaagcccttcccaccgtggatacatacagtgtcagggacgaaggcgagatggtattgatgggatacctggccttcctggatcctccgaaaaaatctaccgctgatgcactccgcgccctgaaggaacacggcgtaaccacaaagattcttaccggagacaacgaccgcgtaacccgctgtatctgcaaacaggtgggtatgaaagtgagcaatctgcttcttggttccgatgtggaacgcatgagtgatgatgaactgatacaggctgcggaaaccaccgatgtattcgccaagctttcccctgatcagaaggcccgcgtcgtatccgcgctgcgcagcaacggacatacggtcggctttatgggagacggcatcaatgacgccgccgccatgaaatcggcagatatcggcatctctgtggataccgccgtggatatcgccaaagagtccgcagacatcatccttctggaaaaggatctgatggttctggagcaggggatcattgaaggccgcaagacctatgccaacatgatcaaatatatcaagatgactgcttcctccaacttcggaaacatgttctctgtgctggccgcatccgcactgctgccgtttctgccgatggaaagcatccatctgattctgctgaacctgatttatgatttaagctgtaccgcaatcccatgggataatgtggatgaggaattcctcactattccccggaaatgggatgcttccagcataggcaacttcatgatatggatcggacccaccagctctgtctttgactggacgacctacgctttcctgtactttgtgctttgcccgttctttgtatcaaacggtgtccgttacaacgatctggcagcacactacagcggtgcggagctggcaaagatgcagcagacctatgccgccatgttccatgcgggatggtttgtagagtccatgtggagccagacccttgttatccacatgatccgtacaccgaagctgcctttcattcagagccgtgcttcagccccgctcacactgcttacctttaccggtatcgctgtgctgacgattatcccctttaccgccctgggtaccatgctcggcttcgtagccctgcctgcagcatattttgcttatctgattccctgcatcctgctgtatatggcgctggctactattatgaaaaaagcatatgtgcatcacttcggagaactgctgtaaccggtattttctgctgtggtttggaataaatgcaaaagagacaggcgcgcagtatgtgataggttcacattactgccctcctgtctctctttttaaaccttttaatgaataaccggccttcccgcttttctacagctccggctcttcactgttcatccacatgccgttcgtaaaatcgggaacagccaccggctgccctccaagggcgatggattcctccgacaaagcggtgatgcacatccaggatgccgcatcatatacatccacaggacacggtcttttctcaataacactgtcaaagaaagctctcagcacaagccagtccatgcccccgtgtccgcccagcactccgtcattcaggaaatccttccagataggatgatcatactcctcctcgtattcttttgcatttccccaatatttacggaaatcaaactcttcttcttccgtatattttccatccaggaatactgtatcattttcttcctcatacataccctttgtcccgcagaccgtaaaatccctgctgtaaaaacggggaagcgtggtgttgagcgtcagaaggatcgtctctcctcccgcgcatttgattattgtgtttaccacatccccctgggcgaatctcgtctgtaccaggctctcattttccggatgcctttccttcgcaaaggcgtgcatcccttccgctctggaggccatggatgtcagcgtcagcatccggtttccgtgattgatatgaaggatcttggcaataggccccagctcatgggtgggatagttttccgcattcctgaatttataattgcgcaggcggtaatgacgcttttccagaccggttcccacttcctcacgaaggtcatgcatatagcctcccctgcagtgaaccacctcgccaaaaagcccctgccttaccatgttcagtgccataagttctcttctgccgtaacagcagttctccaggaacatgaagggggttccggttcgctcataagcctccaccagatcccagcactgcctgatactgtaagcgcctcccacttccattccgaccgcaatcccggcctgcattgcctccaccgctacgggaatatggctctcccatgcgcaggaaaccaccacagcctccacatccttcctggccagcagttccctgtaatccgtcgtccatgccggggtgtgcccgcacagctcctctgtcagccgggccgcctcttcacagcggtcctcataaacatcacacaccgccgtcaccttaaccgaaggcattctgagtatcgcatccttaagaagcccgtatccccggtttccaagtcctatgattcctactgaaagttttttcatatggtttatcccccatttattccctgtctcatccgcttaagcgatgtcataaggttttctatatctttacttttaccatatccaaaaatacatttctataggatttgggggacaaaatctttgaattcaggtatgttccctgcgcgccatataaatgcggggtgcggctcccgttgtcctcttgaaaaccgtgctgaaatagttctgatccgaaaatcccaccgcagcagcggcctgtcttacgctcattccctcttccatcagcctggcggccctgcgcattttcatctggttaaaataggccatcatgccgattcccgcatatctggtgaaggttttctttatggcggattcactcatgctgcacaaacgggccacctctgcaacggtcagcctctcctccacatgttcctccagcacccggaccaccctgcggtaattctccgctcctgcagactgaatccgggtaaaatcctcttctcctcttgtacacgcagaaagaaggatattttcaagcctgctgacaaacagatgggcttccgcttcctttcccgctataatcttctgtgtatatatctttcgatctatctgaaaaatacgcggcacacaggaaagcagttcgcacagctcttccacctcctctttccccggccggaatctccactccttcattgcaggcatgatatctccggtaaatgtcaccacaataatatccggacagctgtccttctccgaccagaagctatggaattccatgggccggtgcagaaccgcctggcctgcctccagaaggaaaacatccttaccggccgtaacccctatcgctccctccaccacacagacgagttcccagaaatcgtgggtttcccctccgaaataatagtcttttccgaaaacctgtctgaaagcgctgaacagggcggatatacgtatgcatttttccactacgcagccttttaatgttacattatttttcatattgggttccagtatcctttcctgttttcagaataccatatgttttttgaaaagtcattggtgaagttattggtggggggtgggccctgagcttcttgtcttcggccggcctgccttcccgctgcggattccctgcccggcggatgtgtatcccctgcgcaggcacgctttcgctctgccaaaaacgcagcggtactaagattgcagaggacgcaatctaaggaccggcgtttttagaaggcctttgcaggggatacacatccgccgggcagggaatccgcagcgggaaggcaggccggccgaagacaagaagctcagggcagagttatgtaacgtaaatggggaggaagggaaaaacagggaagagggagttactggtcacggagtgaacagtaacaagggagcggagatttgggggcttgacttgtgtgctctatagtgatagagtaggattgtactctatagtgatagagtgaatgggagattatatgaatagtaaaaataagatcagtgaagcggaactggagattatgaagattgtatgggagaggcaggaggctgtggccagcagtgatattgtggggattttgaagaagcggtgcgggtgggaggatactacggtttatacgatgctcagcaagctggtgaaaaagggggctcttctgcgggagaagaaggctgtttcttattattctgcggctctttctgaggaggagtatacgctggagcagacggagcgtcttattgacagattgttttcgggggattcgcggcagctggtgtctatgttggtggaaaataataaaataagccgggaggatatccattcgctccggcagttctgggaggatgagacggatggctgattttctgatactgcttctttccatgtctgtatccggaagtattctggtgcttttgctttgggggctccgtcctgtcctaggcaggaagctttccggagcgtggatgtattatatctggattattgtggctcttcggatgctcctgcctttcacgccggagcaggggcttcttaaccgttttccaggcagtctgggggcggtacggcaggaatcggccgtggccgggggcatcggttcgcagggtactttgatgtctgataattccggtatggcggaagacaggatcggaaacgctgatctgcaggatacttcttcccgggagatgaatgatatacaagagcaggaggggggttatgcagacatcccggaagatgtccagcctgtaaatggagttttctcttttctttccgggcatctcgcgggtgccgtgccggcagtcttgttttttatatggcttaccggggcgatctttctttttcttcgggcagccctggcctcccgtatttttccggagcgtatccgcagggaagcctttcctgttgattcggcggaaataaatgcctgttatgaaaaggcctgcggcaggctgtccattcggcggcctccgcagctgctgggcagcacggaagctatatctcctatgcttatgggccttctgaagcctgctattgtacttcctgtcagtgtcctgcagcatccggaaaatctttcttttattttccggcatgagctgattcattataaaaggaaggatatatggtttaaatggctgtttcagctggtggaatgtgttcacttttttaatcctttcgcctatcttctgcgccgtcaggtggagcgctgctgtgaactctcctgtgacgaagctgtggttaaggatatgacatttcaggaacggaaggcttatggcaccactctgctggatgccctggaaccgggtattttttcccgttctcccgccgcttccgcctccctgtgtgaaaatgctgcatttatcaaagaaaggttggttatgatcaaaatgaataggaaaaaaagcacttttattaaagttatcacgcctctgcttaccacaggaatctgcttcggtgccttttatctgggggcctgtgctgctcctgccgattcctccgctgcggggaatgctgttcctgcctctctttccaaacagtcacaaacctcagggcctggttctctcacagaactgtctgctgcggttaatacgccgtcttcttcgaaaaatactgcttcctatatcgatgcagaggcccctgacggctttactcttttgaagacagagactgcttccctggattctgtccggaatctgaagcttcttctttcctttgaagacgtgaccctttatccagctgcggataatactgttacaatgctgttttacggaaataaccgcattacctatgcgaaggacgaaatcgcatccctcaggcagacatcaggaagtgtttccctggagtccggcaagatgaacaaagcctggagcaggctgtcctcggataaatggcaacctaaagtttatatatacctgcccgccgactttgcaggaaatctgcaggtgcaaatcggcagcggcagtctgcagagcaccacaaacctgcaggcagcttccgcttccttcgaaaccgcctcagggaaaatggttctcggggatgtcggtgcggacggtcagctggcccttaccaatcattccggatccacaaacgccggcagcctttccggggaacaatgtgtgctggacaacgccagcggcaggcttaccaccggaatcatcacatccctgaaggccggctctcttaccaatgcatccggtaaactgactgtagggaatattaccgccggtcaatgcagtattgaaaacatgagcgggaatctcaatctgggtctgctggatatatccggccctctgaagctgaccaacgtatccggtcccgtatcaggcggacagattactgcaaaagaatataccgtttccacgggcagcggcagaatggaaatacagtcccttgccggtaccggcagtctcaccagcggaagcggcagtatccgggccggttctctggcacttaccggagcactgaccatggaaaccgggagcggaagcatccatgccgccattccggaaaatacgggaatagacttaaccattgcttctgtcggaagcggcagcattaataccttcttctccattcctgattataaaaaggctgactccgggacttccgcccgttatggaaatggcccttatcaccctgttacagtaagcgccggcagcggctccataaatctggaaaaacagtaaacaaaaagcatcacggcggtcagctgtcgtgatgcttttgttttatctgtattaaatttatccgcttccttactcttcctcaaaagcgcggttcagctcttcacagccctccagcacaaatcttccgttccggattatctgatattcccttccgccgccgtccacggcagtcagttctcccagttcatcataaggtatcgtaatatccgtatggcagttaaaatatacagccgccatattctcacgacgtccggcggatacttcattatccttggctatcagccgttttccatcaggattgcaggtaaccagatcctcttcatgggaatagcaggtatctcccaccgcaaaatgaggccccattttttccgcaatcaatatgggcagcttatctccgatatcgtacttttgtgcaaacacataagcggtggtattcgtgcctacggcaaattctccgataggcagcgtgtcatggtggtgaagcacattttcacggataaatttcttattttcttccggcgtttcaaaattggtacagctataatccgcaatcataccatctttgaattctatttccaggttcaggtatttcagcccgttcagataaaccctggtcacatgcagccttccgtctgtccccttcagtaccggagaagtgaacacctctcccacggggatattcacatcggccacacagttttcaaaattggtttcctccgccgggttttccagcttgtgaagcgccacccgcagatctgttttgttggcgccgcagcctttgatatgcacatattccgccttgtcgagagtatcgattatcttctgctggattccctgataaagcttataatccagcgtattgatacggagtactccgtcaaaaatggtttcaaagttctcccctatctccggcacgggaaaagcgatgatggtaaagcttctctcatccccttttacatattcattcatcaatgcgcccgccgccgactggaattccaccgccagcttctgctgttcctcattcagacgcaggttttcttccttgctcaccggctcaaagggaatttccccgaattcctcaatcaccgcggggccgccgtgcacagccgccagctccttcacactttccagagcattcctgtaattttccagacggtgatgcacatatttcttatcatagaacaatgcctgatcgtattcatgatcatagtcaaactgcttgttggcagctgaaccatagaaaccgttcttattcagcttgcggccttcaagaaagctggccggcgccctgtaaatgacagactccaggcccattttacgaaagttttccaccgcttttttaaccacccgttcaaatcccaggaaatagcggatattcacggatttcttcttatggatatccttaccggtcacttcaaacccgatgcggtagccttccgtataggtatctgccatcaaggcgattttttcttcgggaagagcgttcagatagcccgccatgcgcagttcattttctgttatatattcgccgaaccggtacagatagcgcaggtccgtcaaatcacactccatgattattttaagggcgaaatcttctttccagtcaaaggtggagcgcatgcttttttccagcatggtttcggaatagtcactggcaaaccaatagatcatgtccctgatttcctcatattccggtaaagcctttctctcttcttccgcaaaaacgaaggcatgatatacctcaaggaaaagctccattcgtattaccatggattccatatcctgttcataagcaaaggcgataaggcttctttgctctgccgccagaaaggacaggacctgcccgaattcctttcccagggccgccgctgcaaaagcagggttggcatagctttttccataattttcaggaaggacatccgaataaaggctacggttattctcctgcagttccccgataccggcttccttaagccgtccctcagccacattaaaatactcctgtacaaacagttctatctgctttgccgttttaacaaaataatccctgaaggcctcatccgcaagctcttcctccccaatctgggaaatccgttccctgcacagggaaaaacgttccgcaagaatctgttcctgcagaccttcttcctttgtttccatgctgatatctttcttttcattcataatccatacactcctgcatataaaataaaaccaaccccggcaatcgccagtacatttaacagaattcccagataagagaataaataaaatttatcttcttccattttggacatgatacccaaaacaattcctgtcagggcaaaaaggagggcgaacaaaacgcccatgccgtacttcaccagagcctctccctgattctgaaaggtcccgtatacggccagaaacagggaaaacagggaaactgcccctaatactgtggacataattcctttcctggattcctttttattggtaaaaatatatttacggcccatttcattcctccgcctgcatccgatttcccacactgtcatactatcaaaaagtgcctccgcgggcacgctgccagccgattgtatccggctgtaagcaccgtaccccggaaggcacccttgaaaatcagaacataatcctggactttccggccagcagctttgctccgcttataattaacagaacaccgccgacaattcccgttaccatagtcacaatccccagaacaatattcgtaacaccggttcctctcattgtcctgtaaattttttcatccatagatatcctcctatttcactccatactgcgcataatatgcatcaattgacgctttcatggcatcgtcaataataatctttccatcatgagttctgttatacagatattccaccacttcttccatgcttacgatggcattggcggggaaaccatacagctcctgaatctcctggagggcgcttttctctccttttcctctttcgcagcggtttaaggaaaccatcagcccttttatctcaacgtcagcctgagccttgataatagggaatgtctcttcaatggacttgcctgaggtggtaacatcctcaataatgaccacccgatctccgtcctttattttgcttcccaaaaggattcccgtatcaccgtgatccttcacttccttacggttggaacaatatttaatatccttcccatacagctcgctgatagccatcgttgtagccacagacaggggaattcctttataggcaggcccgaaaagaatatcaaaatcaaggccataattatcatggatggcctttgcgtaatattctcccagcttacgcagctgcgtaccggtcacataagcgccggcattcatgaaaaaaggagattttcttccgctcttcagagtaaaatcaccgaatttcagaacatcactttcaatcataaaatcgataaattctgatttatatgcttccatcatccacattctccttttgttaggggcttattttcctaattctaccacatcttttccccattatcaatcaatgggtttagggtgcagataaaattctgagtgggcggctccgtctgcccgggatccccttccgtttcctccagacggcctgcggcttggtaaggttccttatagggcgcgctttcgctcggacaaacacgcaacggtactaaggttgcaaagtacgcaacctaagaaccggcgtgtttatacggcccttacaggaatccttaccaagccgcaggccgtctggaggaaacggaaggggatcccgggcagacggagccgcccactcagaatttttatctacacccgttattatatggttcccagcgcggtaccgatatcctcaatcatatcaagcacggcctgcctggaagcatccgcgtagttggcttctgtgaaatgggcatatttttcctgctgataagcggcgatgatccctctggaggaattgacgattgcacccagaccgtcttcattgaagaaaggaagcagatccgcgccctttcctccctgcgcgccataaccgggcacaaggatataagacttgggcatgattttcctgaggacggcgcccatttccggataggttgcccctgccacggctcctacatagctgtaatcctctcccatggcttcctcgccccactgagccactttttctcctaccagctcataaagcggccttccgtccacaagcctgtcctggaattccccgctgctggggttggaggttttcaccagaacgaaaatcccttttttctcttttttgcagacatctataaaaggctttactccgtcggaaccaagataagggttaaccgttgcaaaatcctcgccaaacccttcaaagctgtggctccccacctgcgccctgcccagatggcccaccgcataggcttcggaagtggaaccgatatccccccgcttgatgtcgccgattacaacaagtcccttttccttacagtaatccactgttttctggtaagcgatcattccttcaattccaaactgctcatacatggcaatctgaggcttcaccgcaggaatcaaatcgtataccgcatccacgatccccttattatactgccagagcgcctctccggcccccttcagcgtttcgccgtaagcatcaaaggcctgtttcaggatatgctccggaatgtatttcatcatcgggtccagtcccactacaattggggcattggttttctttattttctccaccagcttgttaatcatgatatccgttcctttccgttatcgctttttatgtttcattcagccatgctctttgcctcatgcctgaattataaccttttaatccgaaaaaattgtatcatatttacaggccggaaacaaggctgggattgccaaaagaacgagggaaaaatgacacccaaaccataattcttatgattccgtcaatacccggcaaagcttcttaaaaaaagcaatcccatagtacgtaaaggtatgaaatccctccagcttcagttccgcatcgtactgcttccgctttatctgctccaaagcctctcttgcactgctgtccagctgtgcaaaagtatctgccactttcaattcgataatgaacgcagttccgtcatagggagccgacaataacagcaggtcactcctgcccagaccattttcccggttcgatttcaggatatagccatccagcattttcagaaggcccgccagaaaaccatggtaatagtcctctctatagtcataaaaactgattgtttccatcaggcttttggacagttcccgttccagtatttctgtttcccgatgcagcagggcatgatacatctgagagaaatcctttttctggatactctgattaaaccagtccagaatggtattccggtaaatcatcttgatttccgtattcggtattcctaacgtcaggtagatcgtctccccatcaaacctttccgattgttttttcaaatatcccgtaaaaaacaggaaattccacaggttatcctccgatttatatacttcaccataggtgatatcctcatgcacgggtttttctattgttccgccgtcaatcaggctctccatctcctgtttcacgctgttatccgcatgttctaccagctcgcggacaatgctgtttgaggaggtgttagcccaataaggtctgggaaatgcgtcatggtcggcggataccgcctttacataattgatgacgctccatggattataaacctctgtctttccaaaaagatagccgtcataccattcccgcacttctttgcacttctcttctattccataaacagataataaatctgctacttctttttcggtaaatccaaagtgttcggcgtaattcgtattcagtatggtaatcatttcaggattgtttaagcctgtaaaaatactctcttttgttatacgaaggcagcctgttataacagcgaattccaaatttaaatttgatttcagcgcagattcaaataaagaacggataaagtccgacatttgcccataaaagccctggaaatatgcgttttccaacggaacatcatattcatcaagtaaaattatgacatttttcctgtatactttttttaaacacctggataggaaattcaatgctttggcccaggccgaatcagggccttttttttcaatcatttcccgaaattgatttttctcagaactattcaaattggagttaagaagaatatagctgtgccggtcaaattcctgggcaatttcatctaccaggcattcataagctgtttggaaatccggttgtttcgcacattttaatgacaaactgataaccgggtattgccccatatatttcgtatacttttcaccggtatctaaaatattcaggccgtcaaaaagctttttgttgtctacctcatttccatccggatcgaactctttttcaaaatagtattttagcatactcagcccaagcgtttttccaaatcttcttggccgcataaaaacacttacttcacttctgttgtccaataattcctgaatgaagagtgatttatcaacatagcagaaattattttctctgagctttttaaaatcatcgataccaattggaagcggtctcattcttgtgtctcccttaatattacgatttttccgccaaaacctgacagatttctttgaacaagttattctctaacaggcaaatatacgcgctctctctttcctatcctgattatatcctgtttacgtgttctccgcaatgtttccctcttcattctgaaacaggtttccgccgctttttccgtctggtaagaagcagaccagccatgagggcggtaaagggggcaaccgtaaccagcccgaagcttcccacgaccgtatccaggacctctgccgccacatacttatagttcaggatatgatccaccggggttccctgggccatgaataccattaacaatgaaatatacccgccggaatatgctaacagaagggtggtcgtcatagtacccatggcggcccttcccacacggagtcccgacagaatggcttccggggcgctgatatccggcttcttgccgatcacctcccaaacggcggaggtgatgtccaccgccagatccatcatggctcccgatgcgccgataaatatgcttgccataaaaatagaggttagatccaaatcctggtaaccgctgtaaagcaaagattcggagcttgtcatcacggcaccgtggattttaaacaacccggtaaacagaataccgagaatacaggtcgtcgttatgcctaacaaggcccccgacaccgcagtcagggtacgtttgtccagaccataaacaaaaaaaatgatgatcgccgtcagtactgccgtaattccgattcccacccagacaggagaataacctttcagatagcagggaacaagaatcttccagatcatcaatattgttataaaaaaggaaagaatagcctgaaaaccgatttttccggcaaaaattatcaggaaaaccgcaaagactgccagaaggatcacttccttatccaggcggtaatgatccgaaatcactacagaacggatcgtatctccctgacagcttatggtgagcagcgcccgatccccttccttaaaaattttgtccttttccagggatccgctcaggaagttgactccctccagaatttttcctttaaatttcccgttttctatttccagcatacagctctgttccccggactggatgagcccggatgtaatgattgcagaattatctgtctccacgactttgcctaccgcccgttccgtaccctgataaataagggcatcctcatagcctgtaggcaggcatatgaggataccgataagaatcagacctattaaagtcgtcaggaaaactgaattctgcctcttcagaaaaggcattatcttcattattgtactcctaacagggcagccattttgctgtaaatatccgtgttgtcatagtaaccgtcaaagctctcggcacccacaccctgcacgagcacctccacaggcagaccggtatgggcataggatccgaaattaataccgctcttattattcaggatgtgggtaatggttacggtaagcggctcatagcttccgtagcggatatactcatcctgggcgaattccgcttcctctccggtgcgggacatggtagtctcataggctgctttcagctgtccgtactcatactccgtcatgacaagcgcgccgtcattatcggattccggatgctgatccgcactatctttctgctgtgttgtttcactgtccgttccggcaggcgcctgaaggccgaacagctccgttacatccttcatcacggtttcaaaatctgttttattttccttatatccggatacatagtcggaatcatatttcgcataggaaatcttctgattttcaaaatttttcaagaaggtgtcatagtcggttcctgcaaagccgatagtaaggccgccggtttcatgatctcctgttacgatgatcagtgtttcttccggatgctcattatagaattccactgccttttccaccgcattgtcaagggcaatcgtatccgtgatggtagacgccgcatcattggcatggcatgcccagtcgatcttgccgccttccaccatcataaagaacccgttatcgttatccagcacctcgatgcccttctccacatagtccgccaacgcccattcctcttcggccctgtccagctcataagacatggcgctgctgtctgcaaggtgctcatcaatggcaataaccttgccgtcctctgcctttaaggcttccgcctccgcctgagtctgaaccaccttatatccggcggcttccgccagagcgtagagatcttccttatctttttcttttcccgtaggctgcagcaaaccgccacccgcgaaataatcaaacccgctgtcaatcatttccagcccgatgtcataatagctgcttctggatgcctgatgggcatagaatgctgcgggtgtcgcatggtttaagtttacggtagaaaggatgcctatcttcatatccttctggtccttcagcttttctgcgatagtttcataggtctgtgtaaagtcttcgctcacgttaatgctgccgctccaggtcttattgccggttgcaatggaggtagccgtggatgcggaatccggcgcaaaagaggtgctgtcataggtctgtgcggagcctgctatgggaaaactcatcatggtcagattgtttttgctgtccagttttgttttttcttctccttccacagttacggttcctgcattttgtccctgagagacactgaggtaataattggtcagctgtacctggggataactcattccgtcaccgataaataaaaatacatacttaggggtgcctgcctggatttcttccgcgcctgtgctttctgccgatgcctgactttctgccggtgccaaagactcttcctggctctggcccgcctggctggcgctttcctgccgggttcccgtgccggtgcagcctgtaagagccgccgccagcatcattcctgccaataatacggatacaattttctttctcacctttttgtaatctccttcttaatatgtaataaaactgacatgcttattataaaggagaaaacttaagttcattaaagggttcccgcaaaatgaatgtaaaatcatgtaaaatattccatttgtaccggcgaaccggatttcgttcctccagactcatttccggcggggcatctgcagtttttctagcggaacagctgcagatgttccctgtcaagcatgaacggataatttttcagcttggcaggattcgcaagaacctcatccatggtgcgctcccataattcctccggaacagacacctctcccaaaagctgcctgatatattcggaaaagggctgcactcctccaaaatcaagaagggagagcattttcatgacctcttcctgatctccgtaattccggataaagccgggcagaaaaatccccacagcctttccatgagggagtcccatctcacaggtaatgggataactcagtccatgaggcaggcttgttcccgtatgggtgatagccataccgcccaatgtacatgcccgcatcagcgcctctctctcttcttctccgatttcataccgaagaagcttatcctttatcctggcccaggtccgaagccccatctcactgtagatccggctgtaactcgtagtattggtattcaaatggctttctatcagatgggccagtgtatccaccgccgtatgaatacagccgctgcgggatgccgtctgcagataggaaacatccacaagggccagggccgggaagatgtgatggcttatactctgcttcgttttcttttccagatgggaaaaggcaccctgtgccgcggctcccgggacggttgtaagaacaatatccggaaggacatttttggtaaggatagcatatggggtcacctccgaacccgtccccgcagtagtgggaacctcagctacaggaaatgccgggtataccggcccctgtgcgctgacctgcgctttcgtatataaaagccgttcatcatgctccggattggccatcatcagggcgattgctttggaggcgtccataggagaaccgcctcccacaccgatcacgaaatccgctccttctttgattcccagcgctcttgcccgcatgactgtttccacggaaggattctcttcaatatcatcaaaaaccacataaggaactctctcccgttccagcgcccctgtcacatcctccagggaaccgtttatccttgaagaatgctttcctgtgaccaccatggcctttgtccccagcgccgcaagctctcggctgtggttttccacacaatttttctcactgtatactttggttggcatataaagcttcatattccgttcctctctttcccggtccgctcctgctggcctgtgcggttcctctttcttccgattatatcgcaaatggcggtttcatgccagatacatatgcggcatggaagtatccgatataagtccctgcgtaatttttccctgcacaaaaaggcgcccccgccgccgggaacgccttttttcacattcgcatatttatgcgtttactgcttctttttgctccgcatactttttaatattggatacattggtaattttccggaactcctccccgttaaccacaacgagggtcggagcctgcattactccgtatttgctagccagcactgcgttttcttccgcatcaatgggaatatagttctcattcttcagatattccttagccagtctgcagttcgggcaggtcttggtcgtaaaaaggtattttacatcttcaggtgcctctatctttacttccgaattcttttcataatcggataaggtgaccactcttgcagaaggatgcttcaaaacagaatgggaaaggtcgtattccgtcctgttctcgaattcctgcgcttttccgtcattccagttctgaaccggcctgtagtatcctgtgatacggctccaaacctcggtcactctgccgcacttgggacataccttctgttctccggtaagatagccgtgctcggagcagatggaataggtgggtgacagggtataataaggaagcgtataattctcggcaatcgtacgtaccagattcgccgccgccttccagtcaggaagcttctcgcccaggaacgcatggaatacggttcctgaggtatacagtgtctgtatttcatcctgaatatccagagcgtcaaaaatatccacggtataatccaccggcagatgggaggaattggtataataacaggtatcccccggctttcctgccgttttgattccaggccatcttttcttgtcatgctttgccagacggtaggtggtgctctccgcaggagtggcctccaggttatacagatcgccgtactgttcctggtaatcagccagtctttcacgcatatggttcagtacttccttcgtaaaatcctgcgtcttttcagcggacatatcatctctgagccagttggcgttaagccctacctcattcattccgatcaggccgatagttgaaaaatgattatcaaagttccccagatatcttctggtataaggatacagcccttcattcagcagtctggtgataacctgcctctttattttaagggaacgggcggaaatatccatcatcttgtcaaggcgcttgtaaaaatcttctttgtccgcagacagatacgcaatacggggcatattgatagttaccaccccaacgctgcctgtgctctctccggagccgaaatacccgcctgttttctttctcagttctctcagatccagacgaagcctgcagcacatggaacgtacgtcgctgggctgcatgtcggaattaatataattgctgaaataaggggttccgtatttcgccgtcatttcaaagaggagtctgttgttttccgtgtcggaccagtcaaaatccctggtaatagaatatgtagggataggatactggaagcctcttccgttggcatcgccctcaatcatgatctcaatgaaggccttgttgaccatatccatttccttcttgcagtccttataaaggaaatccatttctttaccgcccaccacggcaggaagctccgccaggtcgtcgggcactgtccagtccagggtgatattggaaaacggcgcctgggttccccagcggctgggggtatttacgccataaataaaggattcaatacattttttcacttccggataggtcaggttatccactttaacaaagggggccagataggtgtcaaacgaggagaaagcctgggctcccgcccattcgttctgcatgatcccgaggaagtttaccatctgattgcacagcacggaaagatgggccgccggagcggaggtgatctttcccgtaattcctcccaggccttccgtaatcagctgcttcaaagaccagccggcacagtatcctgtaagcatggacaggtcatgaatatggatgtccgcattcctgtgggcttctgcgatttcctcatcgtatatttccgaaagccagtaattggctgttacagcgccggagttgctcaggataagacctcctacggaataggtgacggtggagttttctttcacacgccagtcttctacctttacatagctgttaaccacatccttgtaatccaggatggtggatttcaggttacggatcttctcacgctgcttacggtaaaggatatatgcctttgccacttccgtatatccagcctgctccagtaccttctccacgctgtcctggatatcctccacatgaatggcgccgtccttcaccttatcctgaaaatctgcggtgacacgcagtgccagcagatcgataatatcattggtagtctccatatccgtagcattgaatgctttcataatcacatcatttatcttggtcaatgtgaaatcggcagtctcaccgttccttttaattacatgaaacattttccttccccctctgtggttttcgttctctcttcattctttttccggctttgacagggaaaaaccatcctgcggcttatccgtcaaagctctcctataggcttaaaaatggacaagtgtccatcaaaaccgatggacacttgcccctgattgggcgatgaaattattgtatcaccattcttttatgaagtcaatggacacatacaacatattgtgtaagtggtaatatgttgtcataaatatagtagaaagtgacatggaacactaccttgtctggaggaattcgtactcccggagagccttttcatcatccggataagtgctcagatatttctgcataagaacggtagcctgtttaaaatctcccagatattcgtaagctacgatttcattaaaggaaagcacctgcatgagctggtttccttctatggcaagcccggactgaaaagcattcagcgcagactcataatcccctgtctttaaattgcacaggcccagctggttatagatctgagcgtcaggcgtggtgctgaggaaattgctgtaaacactggccgcataattattatccccaagcttctcataggtctgtcccagaaggcggaccacatccacgcctccgttggaatccttcgccttttccaggctgtttctggcattattgtaatcgcccaggtaataattcatcctgccccggttataatcggtcagcttcttatccttactgtccagcacggcctgcagatagccttctcccaattcctgaagtccgttttccgaacaggaacagaaaatattaatccgcatatcataatcttcaggatcaatctccacagcccggtcaaaatccgcctgggccgcctcctgatccccctgttcgatttcaacgacccccttcaggtaataggccgttttttccttgggccgcaatgcggtgattgattcatagaccgcttttgccttgtccagctccccctgtttataataggcggttgccagataataattgatgtcaaaatcaatctcccccagcttggcgtcactgtaggtcagggccttttccaggcactccactgccttttcatactgggtgagccccatgtaggcaagcccctgcccccggtaagacatctgtgcgttttccttgtccagaagcgccgcatcaaaaaaattaagggactcctcatactgcagctgctgtatcagctgcatgccctggtcaatattctcctgcttcggcgaaccgcaggccgatgccgatgtcatgcagaggctgcataccagggctgtcgttatatatttaaactttaccatatttttcattgcacctgttatttccgttatcaaaaaagactccgtttgctttcagattatagtatagcaaatcagctttcttttttcaccccttttatccaggaatttttatttttattttcagctgccgataatgggggaagttactgctcacggctttcctgtaatgccttatccctccgcctgcccccgtttcccgctcccggcctttccgcagatgctgctgcaaaaaaacttgctattgattctgaaaaggtgtagtgtgattattgtgtagtactatagcgcgatgctgatgaattcttaaataaatatttttataaagttaattatatgactgattacagtcagtctatatcactcccggttatatcgtatttatgcagtcaaaacggttccaaagcctgttggatgaaatgtctgaatcaggctttgcaggaaaaggggaatatagtgaaaaagaatatcctgatacagaccaatcttctggtctgctcaattattgtggtgggatttctgctgaccaccattctcagctaccgggccaatttcagctcgtcgctggaaaacatccagcaggtgtcggatctgacatcggaaggaatttactatcaaatcagtacgacattcaataaaccggtgaatatctccctgacgatggcgaatgacagcctgcttcatgatgtgctcattcaggagaaggagcgcatggatgatccggaatttatcaggacaatccgggaatatctgagtacctatcaggaaaaatacggctatgattccgtctttcttgtatccgcctccacctcgcggtattacaattttaatggtctggatcgggtactgacgccggatgatccggaaaatttctggtacttcgattctctgctgggtacggatgaggattataccatgaatgtggataacgatcaggtggaaggggccggaaatgccattactgtctttgtaaactgcaaggtccgggacagcgccggagagttcctcggtgtagtgggggtaggcgtgcgtatcgacggtctccagcgtaccctgcaggattaccagaatcagtttggcatcaattcctatctcatcgacgacgaaggcatcattgagctgtccacccaatactcagggtatgaaaatgtcaatctgttcgaaatgaatactatttccggcgcacagagccgtcagaatatcctggactggaaagacagtgatgctctgcgattctgggatcagaacgccctgggacaaaagcggaactatattgtgtcccgttatctgcccgaaatccaatggcatcttgtcgtggaacgggataccagtatccttttgaccaggctgaatcagcagtttgttctgaccgcatgtattctcgccgtcatcctcataatcatactgatcgtcattacccgtgtcatccgccgttttaaccggcagattatcgatctgacccatacggtggagaaggaacgtcaggatatcttcgaaaaggctaccgaggatcttttcgaaaatatctatgaaatagatatcacgcacaacctgccggccaatcccgccactgaggcttattttgaaagtctgggcgctccgtcaagctgtccgtttgatcaggcgctccgtattatagcccaaaaacagatcaaagaggaattccgaaagggatacatagaaaccttctcgccggaacacgtcctgcgggcctatgcggagggtactgaaaaacttatctatgagttcatgatcagcaaagattccgaacaatattattggatgcgtatcactgcccggattgtaaaactggagtcagatgacagcattcacatgctggtctatcgacagaatatcgatacggagaaacggcgggaacagaagatgcagcttctggcccagacggatgaaatgaccgggctgctgacgaaatcggccacccggagaagaatagatgaactgctggatgaatatcccgatgagcctttcgcctatttcatctttgacatcgataatttcaaacaggccaatgaccagtttggccacgcattcggcgatacggtcatacgtgctttcacccagacgctcctggagtatttccgcaaagatgatactctgggaagaatcggcggagacgaatttgtagcctttgtgcggggagtggattacgccggagcggtggaacgcgcggaacagttatcccgggcgttatgccggacccataccagcggcggcataagctggaagctttccgccagtatcggtgtggttctctccccgggaaatgcaaccgacgccgagacactctttaaaaacgcggataccgctttgtatcagactaagaaacggggtaagaacggttataccatttttgaggaaaccagctctggttcatagcttcggatagtgctgttcttttcgtaaaaaagacgcatcctgttgttcatcttaataatggcaggcttcccgaaagccggttgaccagttttttggagccgcatatcccgatacccagataggtcagctcttccccgcccgccccggctgctttggctatataatcctcatagttctggcagcattgggccacatccgtaaagtccactaccacacattccgcgaattccggctgatagagcctttccctgatagccttaagcttttccttatccgctttaagtaccggaaccggcagcgcaacaattcccagatgctctcttccgtctttatcataaatatcgggccctatattctccggcacctttttccccagagtgattcccagaattcctgcggtattagccagcacgcccgcgggcagttcctcatttaatatcatcacacattttctgtcctgaagttccattttacatcttcctttctattccatacctgcatttctcatatactctcaccggtctccccgatttcttccgctgcagcggggctgtcccccccttcctttccccatttctgtgacaagaagagaccccctagagtcagcagaatgcccacggcggaaacagccgtgatcttctccttaagaatcagcgcggaagtcactgtcgtaacaacaggaaccatataaatatagacactggtctttatgcttcccagcacgcgcaccgcgaaattccaggtgacgaagcagagcgcggaggcccccagtcccaggaaaagaagattccctgcgttggccggttccagaaaaagccgcggctccacatgaaaatccatgagaaagagagccggtatcatgaataccagtccgtagaaaaaggtacgccttgtggcctgtaccacgggatagccgaaatcgctgattttcctggtcagcagggaataggccgcccagagtatggccgctcccacagcaagcagatcgccgaagggattcagaccgccgaagccgctaatcaggaagataccagccattgccatgatgaagcccaggaaaaaccgttttcccggcttttcttcctttttcagcagaaaggagaaaattgccgtaaagaatggggcgatggaaatgattacgccgacattggaggcataggtataggtaagggctatattttccagaaggaaatacagggttaccccgcacagccctgccactgcgaagtacagctcctcttttctttccccttttctttttctgtggggacatcctatccagagtgcaagatatccgatgaggaaacggataaaaagaatttctatggggccaaagctcttcagcagtaccttcgtggaaataaaagtggttccccatacgaaaattgtcaggaacgccgccaaatgtccctgtaaggtattatttttcgtcatcatctgtttccgcctgttctgtattattttggaaaatacgctgatactgtttgggtgtcagcccgataaattctttaaagaaatgggtaaaatggctttgatccgcaaaaccagccattcccgcggcatcaatgggtgcgattccctgttccagaaattttctggccttatccagccttattgtctggagatatcggtagggcgaaacgcctgtctgcttggtaaaggagcgcagaaggtaggacttgccgaaatccgtcatggcaagcagatcgtccagggtaagattttcggcataatgctcttctatataggtacacaaggtttgtatccggggattgggctgcagaatatcggcgctttcaaaatccgaggcatattcccggagtatctgttctataaggaaaaacagggtttcttctttttccagcttcggggcatgctccaggatggcaaggtacagatcccggacggattgggtaatatcgcttttatagactaccgtatccgtaaaatagggcatatagggttttcccgtgatttcgcctaccgtccgttccatcacttcggggttgatattcacggcccggtaatccaggatttctccgttgatgggcccgcagtaatggttatccctgggattgaataacagcagatccccttccgacacgtcgtattcctttcctttacaccatagatggcgctttccgccttccacaaaacctattacatagtattcgtggaaatggttggggaatttctgtacgatgccgctgaggttataggcctcaatatccagatccctgtcatagtaaatgtgtctttgttcctgttcctgaagcatggcagacctctcttccgtcacttgtaaaccttttacagaatactttaacataggagggcgggcttgtcttgtatgatatgacactttgggggataaattttatggggcgtgggggtatggagggctgctaagtcctgttttggggctgccggtctgttcctggcttctgtatctgcgtccgggggcgtgtccgggtatcgggcggcggagtctttgccctggcagtcacagacaaaaaaaggggctgtttctaactgttttgtacctatgttccactgccaacgcggctgaaactcctccctgcggtcgtcagacaggcgccgctataagcggcagtggaacataggtacaaagcagtaagaaacagctccctttttttgagatgcggctgtcagggcaaagactccgccgcccgacacccggacacgcccccggacgcagatacagaagccaggaacagaccggcagccccaaaacaggactcagcagcctggcgaagggtattggcggataaaggggaatgcaggagtttgtttgaaaattggtttgtgggagattgggttacaatgagggaggcgtagtggactacgttgactggattggaattaaatataatgcaaagtggggcggcagatggtagaaatgaattttcaaataggttatgggagtgacggagtagacttttttatattgagggatgtaagaagaacgccaagtctgtgatgtcggcggggccgggtatcagcagacttggcatccatatatatagaagaagtttgaaatttacaagaatggtatagtttatttttcaggggcaggttgtgttattctttggtgaagtacaggagtgtgctgcggtagtctccgaagagcatgggttggaggtagcctgcgttcatgagcatttctccggagtagagttctccggtttgttccaggcggtagcgggctttggggtccaggccggagagtttgaggcgtctggattttcgttcggtttcgtagcgtacctggatgtaggttacgagggtgcgggtctgatctttgtctgttacctgccagcagtcgtagagggagttttcgcggtaggaggcgatgcggtagtagtctccttcgcggatgaggtcgttgtatttgtggtaatcccggttgaatgcaatggcttttgttttttcttcttcggtcagttttgtgatgtcgagttcatagccgaaggttccggcgagggctgcgtgggcacgggtttccatgggggttatgcggcctacggagtggttggggcagacgcagatgtgggctcccatggagcttaaggggtaaaggagggcggttccttcctggatggagaggcgttcaatgggatccatgtcgtcggaggtccagatctgggggctgtagtacagcatgccgggatcgaagcgtccgcctccgccggagcagttctccagaagaaggtcggggaattcccggatgagtctttcctgcatctggtatacgccaagtacgtagcggtgatagaattctcccatgtgttcgctgtccagggctgcgctgccgatgtcggaaagggggcggttcatgtcccatttcacatattctatgttggcgcttcttatgacttttgccacgcattcataggcatagtccacgatttcctggcgggtgaggtcgagtacatattgatggcgggccatattaatggggcggccgggtatctgtatcgcccagtcgggatgggcacgatagaggtcggaatcaggcgatatcatttccggttcgaaccagattccgaatttgagcccttcggcattcactctgtcaacgagggattttaagccgcctctgagcttggtttcattgacctgccagtctcccagggcgcattcgtcattgcagcgttttccaaaccagccgtcgtccataacgagcatttctatgccaagttttttggcttccgcggcaatggccacgagtttgtcgtcgtcgaaatcaaaataggtggcttcccagttgttgatcaggatcgggcgtttggagtggaggtatttgctgcggatcaggtggtttttatagaggtcgtggaaggtgcgggtcatttttcccagtccctgtgcggagtaaatcagtacagcctccggggcttcaaactgttcgccgggatttaagacccattcaaagccgtcgggatggatgcccaggctcatgcgcacgctttctctgtgatccagctctgtctgggcaataaaattgccggaataaacgaagttcatagcgtaaacgcttccttcggtctggctggtgccgtttgttgtcagggccataaacggctgcatatggtggcttgtctctccgcgcagggaagatacggtatgtttgccctcagtgaccttgtgaggggtgatatgtctttctcttgcccagcagccgtgcagtgtgagcaggtcaaaatcttcattgtccatgtccaggcaggcgctgaggattttttccagatagagttttttcccgctttcattgacggctgccacgctgcgtataatggcatcggaatcttcaaaaatgctgtagcgcagcagtacctttaagcccagtacttcgtctctgagcgtgatgataagggtctgggcaccctgtccttcttcttttccggcaaaggtggagggcattccggacagggccggttttccttccaggatttcgtaggcttcgtaatgcagttcacaggcccggtaaccattttcatcccggacgcgcagacagggatcccggaaatcaccggttccccagaccggatactcaaaggagaagctgtccaggtatcctactttgtctctaagatgattatgcttctcctccggactgtcgccgctgcggagcagataatagccgtccatatcctccatccgttttccgtaatacatatgacccagcaggttttcaccggaaactcccatcagataggtggtgttcggcgtgctgatgctgaatattttcttttcttcacagactctgatccccataaaaatacctccgtttttatctcatacagtgttttgcttttttatccattatactttatactgttggaaagaaaagctgtctctgtttctttttattgtcattatgttgcctggcaaaaaaacggttccgtctgaccggaacatatattctaaaattttgagaagtaacttttcagcccccctttctgcctgtaccctctgcgtttgggacgcctggctgccgttgtctggccccggccaggcagaggatcctgtaaggggcgttataaacacgccggtccttaggctgcgtcttttgcagccttagtaccgttgcgtggttatccgagcggaagcgtccccttttaggacctctgcctggccggggccggacaatggcagccaggcgtcccaaacgcagagggtacaggcagaaaggggggctgaaaagttactttcaggagggacctttatgtctgatatccataacctgtctgtcatggaaccgcctgtccgtctctatttcagcggacacgaacaaacgtccccttcccatgcctgcggtcccgggatatggccccattatctgctgcattatgtgctttcgggaacgggtacctttcaaagtgaaaaacaaagctggcggcttactgccggagatgcgtttctgatcatccccggcgttgtttcggcatatgcggccagcagtgccgacccctgggaatattgctggatcggctttgacggacgggatgcggcggatattctgtccgcctgcggcctcaccgctgcttctccggtatatcattcctcctctcctgcctctgttgacgtcaaagctgcagaaggacggatttctccggtatcgggatcaacggatgccgcgccctgcgggctatccttatgttccgtaaaggtaggtgaggcacaggctgccggggatcccgtgggggaatgcctgctttccataaacgatatgctgtattcccagccggggaatacctatcttcatctttccctgctttaccgattcttttcttttctgtccccggatgcgggaaatgccgaaaaaaattccagcgcctatctgcagcaggcgctggactatttgcagcataattatgcttatgtgattaaaatccaggacgtggcaaggtatgtgggaattgaccggacctacctgtacaagctttttacccgggagctggggatttctccccagcagtatctgatccgtctgcggctttccatggccaagcggctgcttgcctccacggatctgcgcattacggaaatttccaattcctgcgggtttgcggacagtgcttccttctgtcatcattttcaggcgcacttctccatcacgccttcgcagtttcggaaggaacccgggcgggagccggttccgtaactatgctacatctcttcctcccgtatgagctgggcaaaatccttcttttcgaattcctggatggaaatgctcttcttattgggattggcataaacgaaggttttgtccacgttttccaggtagttctggattttgtcgttcgtcgcgctgatgatggcctggaagccgagtccccgtatcagttcaatacagctggccactttttccgcatccatcttggaaaaggcttcgtccagcaccaccaggcggatggtcggcctgcgggacagcttgggtgacagattgatgtgataggcctgggcaaagctggcgagcagggctacataaagggggttctgaccctcgccgccggaatttttctttatcattttgctcagcccgattaccagcctttcctctccttccacgatctgttccatttcgaaggatagataggtgcggtaatccgcgtatttctccatattctttttggcttcttcctgctcctgggcgtttgccgtatccggagggatgaaaatacggatcaaatcattcatgagggtgccgtacttgtcttcatgatccatggaaaacatattgatctgatgctccacggagccggaaagcgtggagggatcgatttccagagactcatccatgaacatgtcatagtattctccgtccagtcccttgtttttggttatcttgaactggtatctgtccttgccgaaattcagcctgcggatgatgcggttcagttcatcgcggcggatatacgcttcttttatggcgctgcggattttataaataaagtcttccttgaagtggtcaaccgcaatccgggcctgctccatcgccttttcttcaaaatccttgatacggtcaaaggaaagctcatcaagcagggcctggtaatcctcatttttctcaccactggcggaaaagtcccggttcggatggcgcttcaggtattcggaacggatatccacaagacggtttctttgtacctcaagatcctcctcagcctccgtaatggcggcaagcgcctggcggatcagggtatcgtatcttggatttttcacctgggagaaaaagcgttcccagtcctcctcccatgcgggggaggaaaccagctgtctctgtttttccagcagttcttcgttcttttcgatataggcggcatcgtccgccttgattttgttttccctgtcatggatctggattttcaggctgtcgatatgggcttccaaaaccttttctttttccgctatttcctgcagcatttccttaagaagctccaccgaaccggcgctgagttcctccatccttttttccagcttcttaagctgtgcttcttttttctttttttcttctatatcctgaaacagctccacataactttccacagggtcctgcagatattcatagcttaacaggcgtttggcctgtgcggctgcggcggagtattcttccaggctcttgttcagctcctccagacgggcctgaagctccttctggcgcctgcgcatactcttttccccgatgaaagcccttcttgtatagttatccggattcagacggcgcagctggaagttctgatacagcaggcagtccgcggtaatgccgattttgcaccggcgaagctgctgcacatcctcacacttgatcacgtttccgaggaggaaatggatgaaggcttttacataggattctctgcagtcaatctcctccgccagggcattctcacgcacctggtattcctgggcggcgagtttttccgtatccacaagggatatccgccagtactttttggcatccaggctttcgtagatttccatggcttctttgacgtaagccggctccacgatcagcgccagcttgttccatgccagataaccttctatggcatttctccatttttcatccttgatatcaagcaaatcggcgagaatacggaccggaatatttttgccggtcttctcgtaaagctgtctctgaatctggcttctggcatcctccagctccctgggataggctttgcggcccagcatgatttccatgagatccttctggatgagatccgcttccttctgaagggcctttccttccgctgccgcctcctgatgctgcttttccagatcggtttccacttccttcaggctttttttcagccgttccagctcttcgccggagatggttcccttccggaatttatccatatcccatatggtctggttggatatattctcttcctcttcccatcgttccagattgtcggagagagtcttccatttccgctcacttctttccagcagagtcaggttttcttccaggcttctctgcttggcttccagctctgcatatccgctgctgatgagctgacggttaatttcttcatgctgggaagcataatcagcccttacggaaagcaggttttccaggctctccttctgggccagaaggtcctttttcccttccccggcccgggtctgaagctcgcggatgacttccgtcagctgcaggatagtgagcttgtccagacggtaacgaaggctccgggttctctgccggccttccacaaaccggttgaactgatcccggattcctatcagctccccgatttccgtctgcgtctcttcaatcttcctgcgcatccgcccgtaaaggaccacgctttcctgcatatcctcaatatggatatcctgctccatacagatatattccttcacgaactcctccagccggatattcatccggaacgggatagcgcgtttgaaaagcctggggaacttctccatatccaggccccccagatagacatcatacagattcctgcggaaccgttcgttattggaggtaagaaaccattcctcacgggtcaggtttttctgcaggtaatttttaagctccccgatcgccatggcgcgcccggcggtccggtaaccgttttccggaattcctcctttatgccagaagaacaggcggccgatttcattggtggaggtgtccacatcaaaaaccacacccacacattccttttccccgcttccggtctgttccagctccagcgcgatggtggtggaaaagttatggtttcttttgtattccgcctggttgttttccccgatattgatcatgcctctcaggtattccagcaggctcctgtccgaatcatccgcggcggctttattaaagaagccccttccgtccgtattggcgtacaggacgatctgaatggcatcgataacggtggactttccgcttccggaatggccggtaaaaaagttgatgcttttatttaaggtaagtatcttggaatctatgtagtgccagttattcagcgcaattctcgtaatcgccttaaaggactggcggctgctctccagctgaggcattccctcctgctgctccgccgcctgcggttccgaaagctgtgctgtcatcatctgcggtgtttccatctgctttatctccttctaacgtatcttcttcatccccgttaacctcgccgcccatgccgctctcatcctctgcatcggtttcttcatctatgctgtcttcttcacctataatgccctcttcctctgcattcccctcttcgtctccatcctctccgaagctctgcagcagcttaaggacatcctcacgcatcagcaccagattgatgcagggataaataataatccgggtattttctcccagttcgtccagggcatccatcagttccaccatctggtatcttttcagaaaggcaaaggcccgtttgatttccgtaagggaagaaaggctgcgggaaagccggaactcgcccaccttgccgttcagttccccgaaggtggtgacaatattcacgctggaggaaacggctgccatctgttcatcataaatcagcttcagaagcagaagataaatggttgccagcttgggaatccgttctcccatggtggtttctcccgtcaaataaatggttcccagctccgtattctgttccaggcagattcctgcggcggcaaaataatcctttagaaaatccatgtgcctgtctgcaaaatagaagtccttgtcggccaccatcctgcctgcttttttatcgtattttctctccaggagaaaagtctggcggaagagccttcggatcatctcctgcagcttttcctgctcctcctgggataattcatttatatatggaagcatctcttttttccctttctcttatcagtcagaccgggccgaaccgctgcgctttctttccacaaacatcatggccggataggtgtagcgctctccttccacctgctctcccgaggtgaccacctggaacctgctgttcttgcgcatactgatatcgtaagccaggatcagcttttcaaagtcttcctgacaggttaactgcaggctgcccgtttccaggatcccatccgtcatacgctcctcgataaagctttcgatctgctgccttgtaaaccggtgatgtatcttgttcatctgaaggacctcttcccgggaaagctctttattttcctcatcgggaaccagctcttcggtaaaattccttcttcttctccgcttatacagcggattatcattcaggatttcataggcggaaagattcattttctgcgccacaagccgcagacggtcggcctgctctttttcctcctccggttctcccagatgattcagcagctggatgatcaggccgtggcggtcgctttcatcactcagcagatagttcaggcggctaaccgtggcccgcacatatttgctgtgctcccgatccatgttggcaatacggtgttcaatatcgtcaaagccccgctcaatctgatcaataagatccagcacatcctcgtcctgtcttcttcggtagaagccctccggctcttttccctttttctcccgggaaagctcctgttttgcacggatccgtcctatccaggcatcatcctcccgcatttccttcaggcagcgttttatgtccattttatatatatagaaattatcgctcgttttcaggatgtggtattttttattcaccacttcttccacatagccttccagatgctcctccaacagttccccgtaggactgcttggataagaggcgttcgaaaaatttatccatgttatgcagcatatcctgaagagccttgttcagttttttcgtatttaccagtgccgttttcagcatggtaatattcattctggaatcatttttgaaggaaaaaagagtggcatacacgttctgaatataaatatcggtatcctccagcggctggttgaccagctggtcgaacgcgctgataaaaacggccgcgtaatccgggatgactatattggtggtcatcgtcgtatagtcctcgactttacgaagccatttggcccgcagcagccagttcagtatccgcttaggcactgcttcctgggcttcttcctctgtttccgtctcttcctgctccatcagcagcttctgctgtgcgcacatctctcccagaatctgcacacaggcttccctgctcaggaaaaaattattatactgatattcatcatcaatcgtcaaaagggcttccatataaatttcccggttcaccgaccggaaaagcccccagaaggaggcggggatatcatataaaaatttcaattcggttcatcctcttgtatcttttcaacctgcctgcgcgcttcttcggaaatcgcgccaagaaggtaatttttatccattttctgctgatccaggtattcttcccggagcctgccgctggcacgcttcacttcttcctcaagctctctggcagatagaaggcggcagccctgtccgcggataataacctgctccagaccatcggaggttgccacggtgatatcatattttttcccgttttcatgggtgaatttttcaatatactgatccgcggtttccgcctctctggtatataccacatgaatgttatgatagtcaagtacttccgtcacatgtccctggacacggtaagcgtcaaaaaccactatcacctggcagcggacaatcccctggtagttgcacaggatatccaacagctttcctttggcgccgtcaatatttgtttccgccagctccctcaaatcatcccaggcaaatatcacattataaccgtcaacgagcagatatttttctctgaccgcccctttcccggttcctttataaacgggatccccgggcggaggggtggaaggcctggtcagtttccggttccacccgtcttttctgggctgttccttgtttcttttattggcatgataggtacgggcgagaatttcatcgatttcctccactcccagccatttttcttccggtatttccctgcttttcggggtaagccctgctgtctcttccggaacgtcgcgctgcaggatacggcattccagatgcatataatccttcaccttatcccaaggcaccacaaaaccggccccatgaacacaaaaaaccgaaccggcgggattttccgtatcccgctccggatcataaccggcttctgctatcacctcttccgcattgtggcagggccggtagcccagcagggtgcagaaaagacggccatagcctttggtgtaggcaatcacttccttctgataatcccgcatggtaaacacgggggcttcaccggtgaggactgccatatcttcttctgtacgtggggcctcaaaggttccgtgcattttttcaatgtcggtcatcgccttacccaccattttttccggcacctccagccggaactgataccagggctccaaaaggatgttgtgagcctgcatcagcccatgccgcacagcgcggtatgtggcctgccggaagtcaccgccttctgtatgcttcaggtgggaccgtccggtgagcaatgtgattttcatatccgttatcaccgaacccgtcagcactcctctgtgatctttttcttccagatgggtgatcaccagcctctgccagttccgatccagaatatcctcgctgcagtccgtatcaaactgaagaccgcttcccctttcccccggttccagcagtaaatggacctctgcataatggcggaggggttcaaaatgtcccacgccttccaccgtatccgtaatcgtttccttatacacaatatttcccgcaccgaattctacagccgtttggaaccgttcctgaatcaggcttttcaggatttcaatctgaacctctcccataacctgcgcctgaatttcctgcagcctttcatcccatacaatatgaagctccggctcctcctcttccagctgacgcagcctgggaagcatcaccggaaccgggcactcctgcggcagacggatggaataggtgagcaccggctccagtacgggggccgcagacgctgcttcggcacccagcccttcccccggatgggtgtgattcagaccggtcacagcgcagacgctgcccgcctgcacttcatttaccagctcatatttatcgccggaatagatacggatctggtttaccttctcttcccatacctctttttctcccgccttcccctcattggtcagcacggcttttacctgcaggcttccgccggttattttcatataagtaagacgatttccctgatcatccctggcaattttaaagaccttcgccccgaaggtctttccataaaccggcacagaaacaaaacgttccagtccatccaggaattcatccacaccggtaagcttcagggctgaaccgtaaaagcagggaaacagcttccgttcccggatcaggcggcgaagctcttcttccggaagcccccctttttccaggaaaaagtccaaagccgtctcatcacacatggcacactgctcgtaaaagtcctccgtaaagccttccccaaaatccacacagccttcatccagcctggcctccagttcccgcttcagcgcctctttatccgttccgttctgatccatcttattgataaaaagaaaaaccggaatccggtatctcttcaaaagctgccacagagtctgtgtatgcccctgaacgccatcggccccgctgattacaaggactgccgcatccagtacctgaagggtacgttccatttccgcagaaaaatccacatgccctggtgtatcaagcagggacacctccatatttttccaacggaagttggcctgtttggagaaaatggtaattcccctctctttttccagcgcatacgtatctaaaaaggcatctccgttatccaccctgcctattttccgaagcatgccgctccggtaaagaattccttccgataaagttgtctttccggcatccacatgagccagaattcctatcactaattttttcatatattgtcctgttatctgttgttttgatctctgtgtcagaaaatccaattccatacagcccgggaatgttgtcctttccccggtcagccactccctgttctgctttgtacaaacggcttaagtataccataaaaagagagtaaaaaacagagggagctgcatctgccgctttgtacatgcagatacagctcccctgaattgtccctttcatcaccgtgatggaatagctttgcctcacgatatatgttctgcaaaagcctctactgattccgcctttgccgcttctttcagccattttcttaaaacgtccaaatcggactcctgcagtatttttctgcgcagctcctccggtatgtctcctaattcttcaagcaaagaaaggatatcctctgcttttcctattgcttttccggcagcatttccttcttcccagctaatctgcttttcacttgcgatatggcgttcctcatcatattcggctaagatcatatctcttacctccgctctgtgaccaattaaaaaatcccttaaaacaccatccctgatacaggcctccaccgcctcatccacagcctgttccagcgttttcccctcagccagccgttcccttatgcattgaatgaatttggcatactcccataatttcctgcattttctcatcagctctttattatggcccagattgatattcagcataatcgcacggcactccagggaaggctccgtattttccaatcccggcagtctgtaaaatgcgtctgacagcttcagtacccttcgatccggttcttccctgcttccattataaaagaccagatactgaggaaatggcagctgcaccagacggctgctgtacaggttttcatcacggctctccaaatatttccggtaaatatccgccagatacaggaaccctctcaccggcatattgggtgagtaagtactctgatgctcatataaattcaaaacatcatccactaaaaatgaaatatcgtttttaaaccccatatataccacatcctccagcgtcgtgatttccagagcttccggatcggtatagtttgtgcctcttaccgcattatataaatccaacagttcctttttgctgctgaaaatccagcggaacagcctgtccttatattttgcatttatttttatttcactcaattatttacctccattatacaataatcttgttttccgatcaataaaaatcaacagtccaaacatcttatgctatccgatgactgcagttcacaggattccttagcgcctgcctcttagagtattttctccggcggcatttccgaatgggttgccgcaataatttaaagacggaaatctaatttaccggatacttcaaattttttgaaaataagattttccaatgaaatcataagcggctcaccttcatgaaaatatccccacaaaccgcactgcagacggaactcccctgttttatacgaatcataacgggatttgtaaagggtgatctgccacaggtcttcttttttgccgacaaagagaattccggcaaaaccataagagcctttctcctttttcccatacagaaataccggtctgatatagacgagaagttccaaaagaaatacgccgagaaatacagaaattcccaatatgataaggcaaagctgcgtattttggaatcccttggcccggcatctttctggccaaagactgcacaagggacagatctcatttccctgttttccgcatttgtccgtacagatacattcctgctgtctatccgttttagtcaatttttccgtttcccggggactttcatttccggacagccgctcttttccgatgccgttttccgcttctgtctgtttgtcctccgatccttttaccctgttatgtaaatttaatttccttgtgttttccgctttttttacattctctgttttgccgcctctgctgctgatatccgtatcaggcaaaagggtgagccctggcagcatatctctttctgttttttcctgcggcatggaaccggaatcgttactttccttttctcccggactgcctcctccgttattgcctcccccattatttccatcgtctcctgaaactgcaaacctgcgtaccacaattgtgctttccgatatgtttccaagcaggtcttttccgtaaaaggtataagttcccggttcgctgcattcgaattccgtatctttgctccattcctctccatccctggaaataggctgttcggcgagtccgcagccctggcttccgtccggctggagatcctgtgcttctactttgattaccgcgtttccatacagccacacctgcggagtctgagtcagcctgagcgtgggaccggtgcggtcaatattgtttactgtaatctctttttccgccgtatttcctagtgcatcctttccttttatcagataggttccgttctctgttattgtaaatgagttcccggtactccatgtttttcctccgtcaaaggagtattggatgctgccggatccctccccgcctgtgtcatttttatcccgtccctccgccgttatatggcattcctcagcccaatccagaggagatatggaaaggctgaattccggaggggtcgtgtcaatattggaaacggatatttcctctgtcgctatattccccaacgcatctctgacggctgccgtcaaagtagtattttcttttatgataagctcattatcggcactccacgtttttcctccgtcaaaggaatatgcctcttcagccaatccgcagcctggttctccgtccggctggagatcctctgcgctgattgttaccgtattcgtcagtacatttgcctgtgtatcctgtgctacagttattttcggcgccgtccggtcaatcgtacggatattgaattccttttcctctgtattacccaaaatatccctgacctttattaagtaagagccattttccatgtaagtgtacgtattcccctgccagctgcttccgcagtcaaaactgtatgcttcatcggcaagtccgctgccttcactgccgtcttcctgcaaatccctggcctgcacgctaaccgtcacattatctgccgtccattcctcagggcatgtaatggaagtgatctccggacctttccgatcgatattggcaacagtaatggaaaccggcgcttccgccgaattattatctgtacccgcattcagcctgcaggtatatgtcccgttcttttccacaataaattccgactgtgccgaagggcttccatcattccatatatagccctccgatgctatggaaatatttccttttaattcacaggatgcacggagagtaagctctcttgtccacactgtggtgccaggacgcagagtgaacacagccacttcctccccttccgccgcgccgcatttcctctcataacccagcacttctccttcacggctgcagtttaaggtatcaaagccgtgcgtactgctgtcatatcccttgaaaccatccgttccgggaccatgatgttccgtaaaatggatttgtgtatattgatccgccgctccgcagctgctgtgttttcgaatcacgttctgatagatttcatgcacctgtccatggcagccgcaccatgcatctccctgagaccagaaaccgccgtttccatggaccgtcaccgtacaattaccggaacggtaacagccgttctctttggaatgctgatgtcgtatttctgtgtagcagcctcctcctgtgtcttctcctccctcatgatgatgaacaatagcagtggacacacttccgtctgactccgctgcagccggtaattttatcagaaatgcacccacgaaaataaaagcctggataaaggctgccgtaaaaatacatcttcttatttttttccttgtttcttttttcattactaccttttctgacttccgaacgcctgaaaaaaagtataaaaaatataatctgatctattccgcagacactcctcctttcatagcatatttaagaataaaatgaaaaactgatggctgatacgccatgatgccgtatagttacggcgaatgaattaatttgataaggcctcctgtaaaccagaagatgccgtaaagaaactttaccataaattatgactgactgcaagctgtttatcataaatattttgtcaccagattgttcgtttggctatagttacagtccacaaatattccagttaataccatgtccggcctgtaatattgatttgacatatctccttttacaagccggacccggctgatacaaaaaagaacctctgaaaccgaatgataccttttcccggcagaacagcatagctatctgcccttaattcatatccactgttacataaatatccatataactcacgccgtccttttcatattccgattcaaagcaaggcagacatttcccgtcaggcttatgctttatcccgtttacctccatataagacatgatagttttataggcattaggtatcagctcgaacggattattaaaaggttccgttatagtaattaccgcatatttttccttttcctgggcaactgcctccatatccttacaggaaggcgtaaaatcctcgggaagaatacaggccgccgcatagccatgcatatggaatacattaacctgttcctgtgaaagatagggaaaatcccagcctataatccggtttacacgtccccaggatccggatatgccgttttcttccgcccatcttttcatatgattgagcgcatccgattccggatcatggctgataaccacataacggaccattcggaaagcttccagctcctcaatacggaccggggaataggcttcattttccatattcatattttcccgaaacaggcgatccatggaacaggaaaaaaattgacacagttcaaaagctttttccatttccggatacgctgtttccgattcccattttgatattgtctgccgtgacacccccatccgttccgccagttcctcctgtgtcattgaattgtgcattttccttaagaattgcagattttttccaaaactcatctcttgtccctccttttttctgatatggctattgtaccagctggcaggtacctcctccaccaacctggcatatctttttttgctgttttgtcactttgaagttgcgtgtcttcccaatacgcaaaataaacgcccattatagggcgtttacacaaagctccggacccgtcggatccggagacatttattcattctgtatctgaatttcatttttattcctgagcgaaatgaaaccgctcctgtaccaaagtcatcacttccctcgttttcttccaaacaggctgctgattaaaggctctctgcctgcgaatattcttccgaaattctcacaattataaaacttctcggttgccacccactcgggatattcaaccttctgctcagacagcattacattattcgtatagtccagatcaaatgcgttcataacccgacctccttaggtagatccctgttgtttctttacatctatactatatattttcctggacttttcgtctataatctgctagcctgaaaaaaacaggaaatttatgtactgccgatacataagcacaggaaagaaggattattatggcgatccggttctgggaaatttatgaagagacaaaagaaaaatataagctgcggattttggcggggaaaaacgggatggataatgttaccggctgggttcatatgctggaggacgaaaccataatcaaccggttcagcggagaagaactcgccgtcaccaccggaatgaaagccggcaatgaaggctggctgcttcgcctggtttcctccatgaaaaatgcggaaagcaccgggattatcatcaatacgggaatgtatctgaagcagattcccgaggacgttatcgactggtgtgaagctcacgattttcctcttctggaaatgccctgggaaatttccattaccgatctgatccaggattactgtatgcgtattatgagccaaatgcataaggaaagacaggaagcccttctttttgaacgcctgcttcgcgggaaagaggttccggaagattttctggaggacatcggaaaccgatacaatctggacggcacattccggattttctgccttctgcccaaatataccgcggaagaaaaagtcctgttccgtcagtccgtgctgaagctggaaaacgtgttcggtctgtggcagaacggaagcaaaatcagattcccttactttttaatagaagtgaacgatttatatattcttgccataaatgattttcctgaggaaaaagcggaagaactcatccgccagatgaaaagtattttttcaagtttctttgaaaggaagcagctttctctggggataggtcccgcttgccggggcatacacaacctgaagcaggcgcttgggcgggcacggatcgccgtacagatgtcccggcaaatgggaagacctattgttgattttaatcaaatgggtgttttcggtatccttttttccacggaggatcctgatattctgagaagctacgcggacaggcttctgggccctctggaggaatatgacaaaattcactattcagaccagggggaaggtatcggctatgtggagaccctgcgcagttacataataaacgaccgaagcctcatcggtgtcgcccggtctacatatacccaccgcaatacggtgaattaccggatccagaatataaaaaggctgttgaacaatgaattgaaaacatccgcggatctgtttccctatcagatcgctctatgtatccgcgatatgaagctgtaagaaagctgtagcgccctgtacagaagcgggcagaacgctacagccccaatactccggcggcataatccgacgcttcccttatgagccattccgtcttttccagtgtacagtattggttcatatggatatccgggacctcctttgactcatacataaacgccaaatcgtgctgcctcatttttacaatctccggaataccgatgattcccggaatggaaagaggctccgccttttccagcgcctcccggaatccatcccgctccgtcatctgacaggtcaaatacgtattcatccgcaccgattccctgtgatatacactttccatcccctggctggtatccaccagcccacccgaccttaacggtgtccacacatgaacattattaaaaagatccgtcaataaatggactgcatatcccaggataaaatccttctccaccaccccggcccattgtgctacaaacttccttatattttcttcccacaattcattgtttcttccttcacaggttccccacgggatcccgtccggaagcaaatggcttctgcatttatatgaactggtataatccggcagataatgcaccgcatccggtgcaatactgcccagaagaaattcttctttcttttctgttttactgcccgccgctctcatggccacatgcagatgtatcattgtaaacggcattttttatcctctcatccagtgccccattcatagttcattaccccatgcaatactttcttatcccgccagccacttttcttcgatcagcctttgggtcagaagttcaatcgtatttcctacaaacagccccatttcctgttcattcagataaggatattccctttccaggttttcatgcttttcccgataaaaatcggaaacatatgctcttcggttatccagggcatcctccgcaaattcctccataaaggtattggtgaatcccaccgcattttcatattccaaaaaagtacggaaacaaggattctttttcaggaacagatgatccagatcataccagtcctcttttaacttccatatggcatccttatccttttcaaataattcactgaaacgctgtatggaagggtcaacaatattttccttccacagcacatctgtcagcagatgtacatagtagcccagaaaaaatgatttttccttttccgaataacctgcccacaattctttattcatatatttatcacggaataaaggaactgtaatttctccgtctgtcttgaaatgagagacattggtattcggcgtaaataccgaccagtcttcattcggtactccgctgtcgggagctatattccccataataaattcctgtctttccagtttggggatttctttcatgattccgtctgcaattcttaaatgaaccatccaggttgccatggcgttctcctttgtactttatccatttgtgtctgcccgatacagcattcctgaaactctatgccgggatattgccattatggcttttccaccgtcccaataaacaccggcagctttgtattctcatccacaatcgcgtaaagaaacggcctgtccaatataaccgtctccatttgcatcatagcgccctccgccagcatttccaccacggtagccgctcctgccttcgttcccagctcatccacatcaatgtgcgtcttgtgaataaccctgtcaatatgaatcgtcaggtctccgcagcttccgatcccggaaaaatccgccagatccgcatcaaacgccagaggcatccccatgccggacaggatttccgacagctccaggcttgtgtccgccttgaatttcggcatccccgcagaaacagccgtctgcttttcctcctccatcatacgtaaaaatccttcaccgctcagctggtttaaatagtcttccaaagccaggccttcctccggcaaaagcgccacgaatgaatatcctgttacatatggcttaacaaaccccgccgaatgctcatccttaagaaatcgggattcttccgaatacatcatgggaacctcagcttcacttccgtcttccggataaaagtctgtatcatgaacctgataactttcataaggcttttcccattttccgtcaaaagccaccgcattgacaagatacataatcgccgcctccggtatctcatccagtatatttgttatcatcccgtccgtgttcttttccacccagccattcaaatctttaagcgttgtctgatcaaaaggcgctccataaatctgagccttccattccttcgcattcttttccaaaaactcctcattcgggacaaaatcctcattcctgttgttaaaccagatggaattggccatgctcatttgaccgccctttccgtccggcagctgtctgcaccaggataataattcttttctcccctcttccggatctattccgggatacatggtttcccccatctgccggagcgtatcctttgcggctcctccacgggtcatttccaacgctgtcagcacggaaagaggggataccatggtattgcttccccgggaagccttatcttcctctccgccctccgtttttttctgttctccggaagttctgctgtcccgcagcagctgaagagaaaaatcgagataggatatggcaaacgcctcctctattggtacatcctcctgcgaagccgcttcgctgcggtactttgatgtaagatcctctgtggaagaagaaacagcctccccattcccgcacgccataccgacagctgctatacataatgccagagataccgctgccaggcggcggaacttttttttcttttcaaatcgtgtctttttcataaccgtcccctttctgtaaaaagactccccctctcctattataatggcagtcaaaaccctgtgtccacttcatttccttttttatttcatcaggtaacggataactctgtcattaaaatcctctgcttcttcataggcggcatgtcccaggccttggtacataagcaattcgcttttatttattttttcatttaactccacagatgcttcggcccctgcgattctgtcacagcttcctcctataatcagcacaggacactttatcttatctaattccaaacgggcatcatgccggagacaggaatctgcctggataagaaacctttcaaaatccttcggctttccaatcctcccgagaaccggataaaagatacggtactttttcaaatatcctgctgaatatgagttttccgccgtatcgatcattaaattcttatactgcccttcttccgccatcttcttccagccattgaccgttttccgcatggtttcatttggccccggaagagtgactgccagcacaagcttttcaaccaactccggatgatccgcggcaagatactgggctatcattcctccctgcgagactcccattacatatgctttggaaatccccagcgtcttcatagcctctgcctgatcttctgccatatcccttgtagagtaattttctgtcaggctgttctttctgctgaatatgtatactttgaactgttccgcaaactttatataattaattgcaaaaataactgcctgcagctgtccatggacaggggacagcccgtcgcctaagcccggtaaaataatgagaggtttcgaacctttcccaaacataatatagttcattgtgtcattgtccagaactgccttacagcagcgggccccataaaacataatttcacctctccttttctccggtaagaatgcctgacttcagaatctccatataatcactcaggctttttacataatcatgctgcagaccgccgaaatccataccctcctgcggcgaaatacgtgtattaaaatcctcattaaaacctttaagaaaccatttcagaatatctgctgttttttgcttatctcctctgagtattaatacatcaatatcctccagcaggctatcataaatatcctgccctttcagacggtaccgttcctcaaccttttggcagactgccgtgtctttccccgccgacgcatctataatcagcctgcccttttccggatttctgatataccaggaaaactccagttcagcatacttgattattctgtcaaataactcttccggaagcgccttactccctgcttccaaatattccgtcagttcctgaatgacacaatcaagtacatagaaataaagttcttccttattccgaaaatactgaaacaggctccctttgctgataccggcattccgtatcattctattggtggagctgccggtatatccatattcggaaaactctgttttacaggcggctataatccttctgcgcttttcttcacttaactcttcaaaaattttagcaggcataaatttattttctcctctaatgaccacctggtcatcggtattattatatacaatacttatcataccgtcaatgttattcaaaggattataaaagatatctccgccgctgttacaaatcatgcctgctgatggcattttggcccaccttatccaggaaagctgtcattcacgcacaaagccccataccccgtcctgtcattcggataagttctctccccgcgcacattccttgctccccttctcagaaaagccttcagcttttccccatacagataaggatccttccctcttacgatcccccattccatcatcagcgcagcagcccccgtcaccagaggggttgcaaaggaggttcccgtataagactcgtagccgccccctgctcttgccgccataatattcactcccggggccgctatatccggtttggtattcgggaagcccggcatctcctccatactcagcacaccccttcccgaaaaatctgcataggcgtcataagctccctgaatcgcccccacggtaatcagtttccccgccgtggaaggaatggtgagcgtcagctccggtgtgggggcaaaaaagcgggtatcctccgacctcacggcctgccccggcagatacagctgatattctccggtaaggatattgaccggatccagcaaaaaggcccatactcctgcgttgatataattttccaccggcagaaaatcaaaatagatctcctgattcacggaataaggggagggttcccccacataaatcagaatctgggtctgctcaatgacaagctcggtttttccgggctgatccatcggcaccacggcctggcttccggaaggggcctgaagagtaatccggaaactgtccgcaaaatttttccacagctgtacattgactgtgctttcataatttcccaccgccagttctaccgtctgccttccccctgtctgccccgttgtgcccgtcgtacgtcctcccggaagccgtccggaggtatggcctgccgcagccccttcattgccgcttccggcacagatcacatttttccatacttcggaggcattatccataaaccgttccagaagagaggagccgtcatgcgcgccatagctgtttccaaaactcagattcaccgccagaggcatccccagctcctgtgcctttcccagagcgtaggtgatcccccgcatcagctgtgtggtccgcggataggaaccgcttcccgcctgccccagcttcacaataagaagggaagctccgggagccgctcccgtatagcgggcattggtattgcttcccgccgcaatggccgccaccgccgtcccatgacccgaaacatcaatgctgggcacgagctgaaagccttcccgctctcccgcctcaagcgcctgattaatttgttcctgtgtaaattccactcccgaagaaaatccttccggaggcaggaatcctttttccgcatccggtataagggactgatcccacagataaaggattctgcttcccgcactgtttctgaaatccggcagagtataatcaatccccgaatccagcacggccaccaggcatcccctgcctgtcaggtttccatttcccgcggcttccctttccacataaaaagagccggctgcgggaaagcaggactgctgcttggcagcatacacgttatatatcaattccttgggcttttccacatactcaatttcatccagagcggtgagcgccggtatcaggctttcaggaatggtgataatcgcatagcctgcaagaagaatctccaccttgattccctcatctgccagacggcttatgtctccatgaaactttactatcagttcccacgttttatcctccctgtcaaagcccacattcaatatccgtgatttttcccgctcctccatagtagaatccagactcaggttcaaaaggttctccagcttctgtgaattcatgacagcctcccataacaccggctttggtcttactcctaggttatgagctttttccagtatgtttccaatttcccacacactccagaaaacgttccgccgccggaggcctgtaatactccttatggcagatcaacacaatctcctttcgcagctcagtccccggtacggaaagcactccgattctctgctttttctccgggtgatatacatagaaacagcaccgctttgagagcggtgctgaagaattactttatatattgataataccggacttccctcaagtctccctgttcctgccaacattgcccggctgcttagaaagctcgtcattccccgcctacagcctggaatacccatacccgtttaccatggcatccagcttctgttttgccttgcacatcggacaattgtgcacttcataagcctgatatccgggaatatcgctggtatcaaacatagcctccacacgcagcccgttaatcgacttcaccgcactgaacaccgagcagatcccctgaacctttcctccgtaatactcaatacattccagacttctgcgcatggtcattcccgtcgtggtcgtagccagaagcagaaggacattcttcccctgaatttctccaacaaggttatccctgaaaatcatctggttattcatattaaattccggtgttaccacataaaccgtgttgtgcatattcatggaaggaaaattccccatttccagttcttccgccatataagcgccgatgacctcacaaccgtccagacatacaatggtatccaccacagtctcaataggcagcctctgcacaaaagcctttcctactgctgccgcctcactgcgccgtgtcttcagccctgtcatatccacatagtaattgatatgggagtgactcgttgcaaaatgccccggtattgctctcaggataatattattccccgcctttgagtaaaacttcatcaccttattttccataccttctccttcccgggaagagtccttctcttccatacgccaacacactttcctgttctgcagccaaagcctcgtaagaaacacaaatcatttctccgaaaaaattgactttcaatcatgctttcattataaatctttcaggaatattttacaagttaatccatcttttataatattttataagcacatttcacaaatccagccccgtatttttatcactttcccctattgccttttaatccttcatacgaaccggatccccatccgcgatttccctgtccgccgtacagataatcctgctgtttccatccaccacaccgccggccagcgccgcatacttatcattcttatccagaacatcgaccataagcttctccgcagtcagctccgaccctaaaaatccgcttctttcacccagcacatacacaaaactcctctggttttcatccatatgcagcgcatccacaggaatacaaaaattatacatctccgactgctgcgtaacacggaacatcccgctctgcccaatagtccccatcccttccggcagcgtcaccaacgccgtaaaactgcccgggctcgtttccatttccgtcagataatccaccgtcgccttaatcatattactgctgttccccagcgttatctccgcctctgcccccagattcacatacttcttctcctccttctgaagaatcacctcaaactgtagcggccttgccgtatccgcgaataccaccgaagcccccgacgatgtctgctcccctgccgccacacccacacgggtaaccacacccgaagcatcagccttaacaactccttcctgttccaaaatccccttcagacgcttcagttcttctccggcctcctccaaatccagctgataaagccccagcgtggaatccgactgctccgacctcagactgtcctccagattcctctgcgcatcctccaaagccttttccttttcatcctccgcatcctccagcgccctctccgcatcctgcaccttctcctccagactcttcctggtactcatccaactctcccacgccgaatcctcccccgaaaaatccggcttattcaccgcattcccctgaagctctcccaactgctctgccgcatcctcctgctcccagcccgcttcagaaagctccttcttcacctgcacaagttccgcctccttctcagccagctgcgccttcaaagcatccaactccccgctgccgccggaagccgccccatcccccaaaccatttccgctcaccgtaccaacttccgtaccttccgaaccattttctccccccttcttttccaactccccaatcttctccttaagcccggcaatttccccctccagactctccttcctcctctgcagccccttcaccttatccgaaacactcttctccctctctcccccttccgccagcctcttcttccacgcctgataagcctcctcctgcctctgcctctcctcatccgaagtattcttcaaattcttatccaaatgctcctgcagcgaagccctcgcagacgccaaatcctcctcagcccgccgcaaagccttatccgcctcctcccccgcccgaaccgcatcttccccagccctgctcatttccgcattcttctcctcccctgccaaagccagattcccctgaaccgtagcaatctgcagcctcagcttctccacatccctctccttatcccttatcctctcctccaaaaaatccaaatccaacgcaaacaactcactcccagcctccaccctgtcacccggaatcacaaacacctcactcacccgcagcccctccgccacattcaccgccagctccctgctctgcttcacattccccgacacctccaccacatgccccacagccatcctctccggcacctccaccgacacccgcgccaacccctccgcataaatccccctggacaccaaagtcaaaaccaacatcccccccaaaaacaccccaaaccccttcaataccctcttcctcttatccacttccatcaacatattcccattctcctatcccaatttcctaacctataaacctacaaacctacaaacctacaaacctacaaacctacaaacctacaaacctacaaacaaaatctatcatccaactaacagcttatctatcttttatctttttatcttttatcccttacatacccccagactttgcctccggtcaggggactcacgaggatttggcctctgtggcagtctcgatgccggggcggggggaagggggattggacttatgagtcacgaaaaaatggtgacatttcttactttccggggttcccatgttactgtctgcccaaatggcgctgtctgacgaccgaagggaggagttcaagccatttagacagtaacatgggaaccccggaaagttagaaatgccccatttttccgtccgaataagtccaacccccttccccccgccccggcatcgagactgccacagagaccaaatccccccgtgagccccctgaccggaggcaaagtcgccgcccccctactccttcagccccgaagccacaatccccttctccagataatccctccccagcaaaaacacaaacaccgaaggcaccagagtcaccaccgaagcggcaaacgcaaaacccgccttatcctgcccgatttccggcagatacaaagacagaggccacagcgccttatccttcaggaacgccagcggctgctcaatcagattccaatattccagaaaccccagcaccattgccgaaagaatccctcctgaagacaaaggaagcccgatccgccaaaacagataccattcccctgccccgtctatccttcccgcctccagcagcccccttggaatcccgcagaacccacggtaaataagaaataccggaaatgtggaaaaaaccgccggaagaatcaccgcccagtgagtattcataacccccacccggcttaacaccagatattgagaaagcatggtcacctgaaaaggcatcagcatcaacacgatataaatggtaaacagaaactttcttccccggaaccggtaaaccgcaaaggcccaggccgcagggacccctatcagaagctgtcctcccaatatggccgccaccagctttaaggaattccagaacaccgtataaaactgaggcgtatacaatagaagcttccagtaatgttctcccgtaggatattggggaaacagcctccagccgatatacccctccgcgtttccgaaaagcggcgccagatactgcgaaagctcctgcctgctcataacagaccccgacagcagcagaaaaatcggcgcacacatcagaaaaacaggacccagaaggaggatgaaacgaaaaacctgtccggctgcctttcccgcttttctaaaaattttcaccgttcctcatccccttcctcccataatttttccagaaacaaaatgacccccagaagcacaataccgatacagactgccgcagctgccattttatccaattccagataaacgaaccagttattaaataaatgctgcagcaaatacatgctttcatggggatacgcccccgacaccaggtaactttcccggaacaccttgaaggagttcagaaaggaaagcaccgtaatggtatacatgcaccccttcagctgcggcaatatgatggagaaaaaaatacgtaccttccctgccccgtccactttagctgcctgtatataatcctccggtatggccagaatgcctgccagccacaggacaacggtataacccagatttttccacacatagctgaaaacaagaacccagaaagccaggccggtacccatataatccgtatgcgcggaaagcagcctgttcaggaaaccgctctcggaaaaagtcatcttccaaatcaatactatcgtcgccgccggcattgccatgggaagaagaaaaaaggatttcagcagctgcgcctgcttcatgttggtaagcagaagagccgccagcagccccagtactaaaagaagcggcagacacaccagcgtaaaacgcagggtattgcccaccgccaggcgaaacgccctgttttcatatacggttacataattctgaattccaacaaattctcccgtgaccgccgttgtaaaggaacgtttaaaaacgtccagaaagggaagaagcacaaagaacaccacccccagaaagctgggaagcagaaaggccaggaaggccctcctgcttttattccacttttttttcttcaaattaaatgctccttattccgacagatagatagcggttttctgctgtatttctttaacagcctgctccacactcatacttcctgtcaggacctgcacgccgaattccactacagcttcctccagtaccacattaccctccagtgaaatttcagcgttctgcgccagttccttcactctggtcgtgacagcttctgttggataaccataggaaaactgcatatctttcccgccaactttccatccggttcccatggacatctcaccgtcagactcatcctgactgtcgaaggccgccctgtttaccgggaaaccactccccgtattcatcttctgatattcttctcccagcatcagcttcacgaagttcactgcctgctcctgctgggtactggacgccgataccgccagtttatccatcggcaggtaaccggtcccttcctctccgggccataaatcaaatacatatccctgttcatccacaaccttgctgaccgctcccatatccatcagcatattgcttgccgttccggccattatttttatcttatcgcccactgtgagagccgccagacctcccagactccaggctctttccgtttccccccagacctccagttcttccttgctgactccctgcatatccgccttataaatccgcagggcctgattcaggaaattggatacagcctgggtatccagttcctttccgtcaagccagccgacgctgtttacctccatcagctgcagcagttcctgccgtgcactgaaggctcccgtaatactgctctccgggttctcctgccgcagtttttccacaactgcggcaagactgtccatatccttcacggcttccacatcctcctgtctgccaaacagcagcggaaggctgaatgatgcggggatcacaaaggttccgttttcctgcttataagcagaggcgatattttcaaacaccgcctgctgatccaccagctccttcagcaccggagacaaatccgcgagcattcccttcccggaatatacagatgcatccatcccatccagcaggataacatccggacccgttccgctcagcagctccacattcagatttttcaaagcatccgtcaccgtcatagaggaatccttctccaggaaagcatacgtgtactcatatttcacatatacgtccggattctgtttctggaataaggccattgcctgctttattgaaaaattttcttccagactgtagattttaagctgtttttccggcactgtgggttcattgggatcataggtgaaacgaattaaatcctctcctgtcgtcagaagcagaaattccccgctttccagcctgaccatggcacacattccaagcatgggatccccgaagctgctgaagctgccttccaccagctgctccatgacattgccgtttctcacatgccggtacaggccgctgctgtccgcaatataaagggtgtcctcttctccgggaagcacaattccgccatagctccccgaggtattgttcagcctgcccttcaaattatttttgcaataatcatccagaaccgtatctttttcaagcatactgccctgttctatatcgtatatggcgaccccgctgtttcccagacacagcagctgagtacccgcaaacgccatcatttcaggctgctcagacagcgtaaacaacagatttaccttcccgttttcccaatcaatggaacagatttttccggatactgtcgagccgaaacactccgtttccgatttggcaaacaccttattaatgtaatcaccatcctccagctgtcccagaacttcccttttgtttcctgccgtatccatgccgattatgttatagaccagttcctggttttcgagtgactgtacatgacacagaataaggcttccatccggtgcaatggagctgttgtttacaaacccgtcccgggggactatattactgtatgtttccgcagggctccagcttttcccctcatcttcagataaaagcaatcctgctgccgcatcaaaataagccagccggttgtcggaaagcatggtcatggtcctgccctcactgtccgccccatccggcaatggcgtcgtgctttccatataccgccccatggcagctacgctgctttccgtctcttccgtactgcttccttcttctgttccttccgccgacgggacctcagccgcagtccttccgcaccccgtcgtacttaagataatggcagagccataaagaatacaaagcaataatgctgttaaacgtttccatccatttctttttttcctgtccataataacctcctgtctgtttatgcacacaatcgtatcataaaagtctctaagcttcctctaaaaacagcaaaggaattagagaaaacttagagacttctttgctatatttttatatgtaatttcagggaattggcggaacggcttgacagcctccgggtttaaaattagagtaaaagaaaacgcagactgcagacaacaaaaaaatacacgatctgactcaaacatcgcacatgccccgccccctgcgtcccgttcctttgggtctgctgtccggttcggattcccctccttcccgccgtcggctatgcagggtttcctgtaaggggcgtataaactcgccggtccttaggccgcgtattttgcggccttagtaccgctgcgtgtttgtccgagcgaaagcgtcccctgcaaggatccctgcatagccgacggcgggaaggaggggaatccgaaccggacagcagacccaaaggaacgggacgcagggggcggggcatgtgcgatgtttgagtatctgagaaaaaggataaccatgaaattattacttgtagaagacgacaaagaactgaaccggactcttacttatcagttggaaaaagaaggctttgccgtggattcctgtctggacggggaagaagcctgctattatatggaagaaggactctacgatctcatccttctggatcggatgcttccgaagctggacggcattggagttctgacggaaatgcggaaaaaaggcgatatgacgcctgtcatcatgctcaccgccctgggagcccttacggataaaataaccggcctggactgcggggccgatgattatctggtaaagcccttcgattttgaagaactggccgcccgcatccggagcataggaaggcggccccggcggatggaagccactgaaaagctcaccttcgcagacatcagctatgaaccggtggaggccaggcttaccggccctgaggatacctgttccctctccagacgggaaggggcactcatggaaacctttctgcgcaacattggtcagtccctctcccgcccgattctgctgtaccgggtctgggggccggatacggacgtggaggagggaaatctggataactatatttattttctgcgcaggcgtctgaaagcagtgggcagccgtgtgcagctgaaaaccgtccgcagtatcggctatcgtatggaggactgctgaaatgttccgtcaagtacaccgccgtctcacctttttatgtgcaggcatcacgatcctggtactgatcctcatgtcctgcagctatctttatatttccgaaaaaaatctgagggaatccagttttacctcttttcaaaacgatatgaataccctgctgtccaatctggaaaaccagacggtcatcacccatgaatggctttccaagatggaaggaaacggtaaatatctcctgagcctgagagataacgggcaggattttctctgggggcgccaggaacacgatcccgcctaccgggaagccattgacgccggctggaattattatgatgcaaattccggcggatttccttccgcgcagccttttactatccggcatcaggaattttctttttcctcttccggcggaaaaaatgacgattattacggatgcatcgctttttcttcccgtgataccggcactctcaccatcttgattcttcgttccatgggaaacctgcaggaacgcatccagacgcagcgaaattcctttctgatcctgattgtcaccgcctcacttgtcctggcctttttttcctacctttttacaggtctgcttctgaagcccctgaaaaaaagccggcagagccagattgaatttgtcgccgccgcatcccatgagctcaggacgcccttatccgtgattctctccgccagcaacgcctgccggaaggctccgcctgaggagcagggaatgttttttgacatcataaaaaaagaaggggatgccatgtcgggcctgatctccgatctgcttacccttgcgggcgcggacagccattcttttaccatccgggctgcttcctgtgaaccggataccctgcttttggatacctttgaagcctttgagcttcttgcgcgggaaaaaggatatcatctttccatacagctgcctgaagaaaaaacaacacccgtcttctgcgacagcgatcgcatccgtcaggtgttgtccgttttacttcataatgccttcagcttctgtccctccggaagcaggattaccctctccctgagccagcaggataaaataacctccatcagcgttgccgacaatggaccgggaataccggacgacagaaaagcccatctgttcgatcgcttctaccggggggattcctcccgccaggacaccgggcatttcggcctggggctttccattgcccgggaaatcatggatgcccatcatggaagcctcaccgtttccgacactccgggcggcggctccacctttaccttaatcctgaacaactaccggaaaaagccctgacacagacgaaccagatattccgtgtccttttctcctgccgtttcaaaggcggaatgcatggccaactgcgcaaggccgatatccgccgcaggtatggaaacatgtgctgaggatatgttccccagcgtagaacctccgggaacatcggcacgattggcaaagttctggcaggggatatcctgctcccggcagatgtctcgtatcaccgccgccgaataggcatccgtggtatatttctggcttccctggaatttcagcacaataccgccgtttaagtaagggcggttggtaggatccgatttttccggatgattggggtgcactccatgggcattatcggccgacaaaaggaagctttccgacagaatatccctcttctgcatgccgtttcgcccgcaggcatcacaaatacagtctatgatatcggacaggaaggtggaatcagccccctgcttggtgccgcttccgatttcctcattatcaaaaagtgcataaaccgcgccgtattcccctgcggccgccctgtcctctttccccttctcagaagcaagaaagcccataagagtcccataggcacactgcagatcatccagcctgggagagccgataaattcaccttccactcccatgcgtcttcctttttcccggcagtaaagataaagatcggaggccaggatttgttcttcctcaatccccagcgtatcggcacacagttttttcagactgttcttcttttctttttcctctccatccccgcctccataaagcggaagcagatccacctgagggttataggcaaatcctttgttgatttccctgttaaaatggatggctacattgggaatgacgcataaatccctgtcaatattaacaagacgggtgacaagcttaccgtcttccttcacaacaacccgccccgctatggacagaggcctgtccagccaggttgacataatcataacgccatagctttccgcattcagcttcacataatgcccttccacatccatttcgggtgtttccttcaccttaaagcagggggaatcgctgtgggatgccacgatgcgtatcccttttatctcgccttccggaatccgaaaggcgatcaatgccgagtcatttcttaccgtatagtatcttccgccgggtttcactcctgctgcttcttcccctgtaattctggcgtatcccgccttttcaagcatctttgccgcattggaaacggcatggaatgcggtgggactgttatcgataaaacgaaacagcccctcagtcatttttcctgtttctgtcattttgttctccattcgtgctcctgtctgcgcgcttttgcataaatacttccaaagccgctctcaaaccaaaaagcggcaacggttccgaacctttcagttaccgcttttttcagttatccggtggtatcttttttcccacgtaatctatattataccaccctgaccagcctatagtataccgcatttattctattttgcgcaaatcacatctgctgtttttctgatataaaagaaaagtaacagccagaagaaacgccgcaatcattcccatgaacagatcgtcaggaattcctgccagcagtacgcgcagccctacgggcacgagagcaaaaagcattcctcccaggacagctgtcatagtcgccccgctttgtttgaccactgtagtctcattatcccagttgaataccggcatcttcagattgaccgtgatcccgaataccacggaaaaacaggcataggctccgggaaccagaaacagccagaccggattgatgcctcctgtctgtcctgagatgacaaggaccgtcccggatatcaaaaccgccggcagcatcagggaaaggcctaccaacatcttactgtccagaatcgtccgggcaggtatcggaagcgatttggggatccaccactgctttccctccatggatatggaagaggaggtggtgctgcccatcatcagcatcagggacagaaggaagggaaccaaatttcccaaagagaatggcaatgtcagcgattccccgccgctcatggtcagatatccctccagcttatcgattcctgtgaatgccagcataacggcaatcgctaccataagaatatacccaatcaaggtattcaggacataaatattcgatgaaaagtacctcttaatctcttttatatacagagccttaagaagagagctctttttttgtgcctgcatccggtaattcttttttgcagcatgggaatgcagggcgctgctgatactcacatatttccactgcaccaaagcggaaaacagcaggaaaaccccgagcgataccgcaggaaatcctgcaagcgccgcaatatttccgccgacaatccctgccgtatacattccggccagcggataaatacgatttacctgatccactcccagcttaatcattcctgccatatccgccatattcatatcctccgcccggaaggaaaacagcagagaaagggcaaggattcccatggtactgaccagggaaaggaagatgacaagcatatttttatgttttaccctggaaccggccgccataatcaatgttcccagcaaagaggcggcggtcagaggaaccagcggcacaaacaggacgcttatgactgctgccgcataaaaccagggggaagggcctgccatccagccatacagcagacaggagggaaccatagtcagcagggacagcataagcgagctcacatacatatggagcagacggcttacaatgatggaaaagggtctgaccggcagcgcagtaagcatatcataatcccctgcggcaaataaaaccggaccggccttgaacaaggtaaacacaaatatggcaagactggaaacagccgccacaaacccgggaacactgtcggccgcccccgcggcacacagcataaaggcagctcccgccgtatagaacaccagcataattcctaacaggatatatacggaaagcagcaggatcaaccgcctttttttccttgcatccctgcagtgtatggcctcattgataccgaatccctttaaaagctgtattttcaacagcaagaagctctggctaatcacctttgaccacctccataaatacctcctccagagatttcccgtgagtcagctccgaagtctcccctgacaccacaagctctccattcttgatgattgcgattttattgcacagcttttccgccacatccagcacatgtgtggagaaaaaaatggcgctgccttccttgcaaagctcatgcatattctgcttgagcactacggaggcgctgggatccagccccacgaagggttcatccaggaccagaagcttcggcttatgaatcagggcggatataatggcaagcttttgcttcatgccatgggaataggaagaaatcaaatctcccagactgtccgtaattccgaactgttccgcgtattcccggatccgttccgttctcaccccggaatccagacggaaaatatccgcaataaaattcaaatactggattccggtaagatgctcatataaatccgggttatccggaatataggccagcatggatttgcacagcagcggctccttttctatggaatgcccgtcaatgagaatttctccttcttcaaaatccaggattcccaccgccgctttgatcgttgttgttttgcccgccccgttatgtccgataaacccgtaaatatcaccgggaaggatttccaggttcaaatgggaaaccgcctttttcccgcccttgtaggtttttgaaaaatcagtaatctttaacatgcttcactcctgttcttcctcacatggagaggaaataaatgtaatcctcctgggcctgcgtccttcctcaggcttgttataaatgtactcattaaatacggctccgattttccctgacatctccatatactcctcatccgtaagaagcaaagtggaagtggtcagactcagcatatccttcctgaaatcattgccttcgtcagcgaaataaccggtaaaagaagccatcagggaaaacagggcggattgaatcagcccttccacactcttcctgtcgccttcacccaaaggctgttttaccagggcatacgtcttctccaccgtcccccttttcctgcattcccgtatcacctcaatacatcccgcctcatacagcaccttgatatggcggtaaaggctggctgtgggaatatcattcagctcctccttaaaagaagctgccgtcccttcctcatgcaatatcagatattggataatacgctgtctcacaggattcattaccacccggataaattcctgctggttcattccaaccgctcccttctcattattatcaattatgatattattctcataagtaataacatttttcttaccctgatattatcacttttgtattactgtgtcaacccaataatacagttttccattttgtcccttccattttccttccgaacaatccgataatcccccattctcttaacacccattcccctcacacgctcctccaacgatcctcctccgggattgacaatcctctgtctcctttgctacagtaaaggaaataacatcaccaataaaaagggagggcatttcgtgaagaaaaaaatatgggaagccgctgtcatggttcttctggttctgtccgtcactctcaacctcattctcctttgcttctgcctgggcttaaagaaacagaacacacagctgagcggggaaatatccgccattccccagcaagtcgacgccagcctgcagactgcccttgcacgcatagacgcgcttcagaatgagtcccagagcatcacttcttatttttccattgatttcggagcattggaaaaaggaatggcagatacaaaggtacgttttgccctgaaggaaatggcggcaggaagcactgtccatgtaggatggtatgacggagaaaaagaacggacacaggaagcccgccctgccgaaaacggtttctttgaagccgacctctccatacccgtaacctgcagaaacggcaccatcagcctgatatataatgatgggaatacagataccgtagagattccggaaccgaacctggatgttttttcccactatttaatccaatggaacgcctacggagatcttggctggcaccggtcaggcggttccctggaaaccaccttcacagccaacgccgaaatcagcagtaccgggcctgacagcaataaaggaagccgtgccatgctttatttataccgtaatgaagaactccttgaaaaaacactgttattcgaaaatgcctatggctactccaataacggctcctgcatcgaaaccaccctcaccccggaagacggcgacatattaagcctccgcctggtcataacagataccctgggatatacctacaaaaaaaccctcgatcaactccttatccctgataaaggagccgttccggaattcgatccgtcttttgaccgtgcagggggtatgcggataattccgccggaagactgagagggagcggataaaaaacatgtgccctgcttcccagccccgccctctgtccggcagtgtgttttatacgtcaccaggtgcagacaaaaaaagaggctgtttctaactattttgctcctccactccgctgccaacgcggctgaactcctccctttggtcgtcaaacaacgccgctggggacggcagtggagcggaggagcaaaatagtaagaaacagctctctttttttgagatgcacctggtgacgtataaaacacactgccggacagagggcggggctgggaagcagggcacatgttttttatccgctcccggcattaagcttttctttacatcggatctcttcttctggtatactgtaaaggatggaaaacattttttaattttgagaacttagttttataagggaggtgggtaactgatgaatcacaaatcagacgaaatatttaagaagcatattcaaagacaaaaattatcccatgcagagcattgattatgtgaaggcatttttctttatcggaggctgatattcagccgggtagggtgaaatgttctgtatgggaaaactaggacgtacgcatcacatattcatgttctgcacttattatacgaaaaataataaggagcggattgattatgaaatgcataaatgcagcacagatattaccggaagatttgctggcggaaatacgccgctataccaatggggaacggcttctttatattccggaagaatcccggagaaagggctggggcgaaaataacggctcccggaatttttaccggaaacgaaacgaagaaatgaaccgtttatatgaggccggaagcaccgtacccgaacttgcggagaccttccatcttgcagaaaatacggtaagaaaaattatatatggcaaacaataacaaaaaaacagagccccggaaagttgaaatgttttccttttatcagtgatgctgcttaaaaggaagcaaatcaattacgggctctgtttttcttttattctccgcttacagtttcataaggccagtccatgattcctccaaaatcatagatctgcgtgtatcccgcttccaccagctttttagcggcctgtgcacttctgttgccgctacggcagtatacgaggatctcctgacctgcatccggaagctgttccggcatttccgtgcctatcgtctcattaggtatcagtatcgctccgggtatgtggctttcctcatattcatcctgcgtcctcacatccaggataataatgtcgtctcccgaatccattctctcttttgcttcctccgccgtaattttatgatattcccctttcatttcgtcctccttttttgttccaccattttcactgcggctgccacaggctgcaagaattcctgcaagtactacggttatgagaataaccggaattattctttttatacggttcataataagctgcctccttttcttttatactgtaattataatagttacagttatatctgtcaagctcaatgttacatttctcctaaaatatatgttacggctcagccatgccctgtgccttcccgcttccgatttccttcccggcgggggccgcgtggaaggaaatcggaagcgggaaggtacgctccacaaagaatggctgaactgcaacatatatggtataatttttaatgttattttcatatttcttccgtaaaatgaaaaatataaaggaggagactgctatgcgactgcttattgccgaggacgaaaaagatttgaaccaggtcattacaaagaccctgcagaaaaaccattattccgtggattcctgcctggacgggcaggaggcgctggattgcctggatatggccgaatatgatgccataatcctggatatcatgatgccccgtgtgagcgggcttgaggtactgaaaaagctgcgttctgccgggaataagactcccgtccttctgcttaccgcaagggacagcgtccaggacagggttgccggcctggataccggagccgatgattatcttgtgaagcctttcgattttgaagaactgctggcgcgcatccgcgtgatgctgcgcagggaaggcggccggattgataactgttaccggattgccaatctgaaggtggactgcgatgcaagatgcgttttccgggatgacatccccattgctttgtcctccaaagaattttccattctggaatacttaatctgcaaccaggggattgtcctgtcccgtgaaaaaatagaacagcatatctggaactacgattatgaaggcggttccaatgtggtggatgtttatatccggtatctcaggaaaaaaatcgatgacggctttaccccaaaactgatccacacggtacgcggcgcagggtatgtgctgaaagaggcctgaaatatgaaaaatatgtccatcaaactgaaaattaccttatggtacactttattcatgacactgcttgttgtgggaatcctctggctgctcctttttatcaccaacagccggctgctttccaatgcccggctgcgcctgaaggacaccgttaccagaagctttcacgaaatcgattatgaagacggtgtgctggaatttgataatgatattaattttcttggagaaggcatctctatttccgtatatgacacccatggcaagctgctttacggaaggattccttcccttttcaacggtgcccccgtgcttgtcatggatgaaatccagcaggtggattccggccagacgctctggtatgtttatgattattgccagaaaatcgaaggctacggcaatctgtgggttcgtggcatcgcttcccagacccagacagacgccgccctccaaatcgtcgtgaacctggctttggtttttctgcctttctttgtcctctgtatcgctgcaggcggttatttcattatccgccggacgctctctcccttagccgacataacggaaaccgcccagaaaatcagcagcggaaacgacttatcccgccggatccgtctgggggccggaaatgacgaggtccataaaatggcccatacctttgataaaatgatggataagctggaggattcctttgaaaatgaaaagcaatttacctccgacgtgtctcatgaactgcgtactccggtcacagtcattctttcccaatgcgaatatgccctgcaggaagatactcctgctcaggaaattaaggactgtatccgttccattgccgcccaggcacggaaaatgtccagcctcatctcacagctgctcacccttgcccgggcggataaagggacacagaagctacattatgagctgctgaatttgagcgaactggcggaaatcataacggaagaacagaaggaaattgcctcagaaaaagggattacactggaaacctgcattcagcctgatatccttttccgcggggatgaaacaatgctgatgcggctcttcatcaatctgatttccaacagcatcacctatgggaaggaaaatggcctgacccgtatctccctgtccagtgacggaaatctaataaccggttccgtctccgataacggcatcggcattgaaaaagataagctggataaaatatggaaacgtttttatcaagttaatcctgcccggagctccggcgagcgggaaggcgcaggccttgggcttcctatggtcaaatggattaccgaagcacacggagggactgtctgcgccgaaagcactcccggctcagggaccgtctttaccttcacttttcctcaaaacaagtgaatctcctttacatcactttcttccggaagtataataaagaagcaggggaagacacccattacacaaaacgaagcataacaatattacagcatcattcagaggggaggacacccattataaaaaacatttctgtaattgatgcgcagggtaacgaatatgaagcgacctggcccaaacgtgccaaaggtcttgtcaaaaacggcagggcacgcttcgtcaatgaaactactatctgccttgcgtgccctccggaacatatggaggctgattttatgaatatggaaaatacttttaaccagacgtctcagccggaggctgaacccgccgctgtgcataatactactttctccccgactgctgcagaaccggacatgtcttacattatccggaaaatcgaccagataatggccgattcccagtatatcagggatgcgctggcacagcttgagcatgcggaaggagccgccgccatggcgattggcaacattgttgaaaacagagagaataccaatcaacggatgattgagctgctgcagaaattattggataacctgaaacctcagcagctggataccgatgtggcaaagctggatcgtattcagcagatattggctgctgtcgatatggatgaggattataaattcgatatactcaatcaggtaatccagcggctcttctaagtttcataacaaaaaagactgccggccctaatcattttctgtgattagggccggtatttaattttatcgttaaatttaatctttctttaatcttgacacgttatccttagtttatcaaaaggaaatcattgaaaggagaaacaaataatgaaaagaaatttatatatcctgcttcccgcacttggcttatcagccgcccttctggccgcctgcggcagccagagcactccggattccgtaacacagcaaatcacctccaaccaggatgcccttgctgcaggcgcgtcttcctccactgtccagataacggaaaacaaagacgatgatgcctcgctgcccgcagcaggtgagacagtcccccttgctgcgaacgcttccctgcaggctgcagcagacagcggacagacggcttacatcagtgaagcagatgcgaaaaaaatagctatggagcatgccggagtcaaggaagaagatatttcctacttcaagctgaagctggatacggatgacgggatcgtggaatacgacataaagttctatgtggggaacacggaatacgaatatgatattgatgccgttaccggtaccatccgcagttttgatacggaactgtctgaagagcaccatcagaatggcacccagggcagcagtaatgccgccgctcccgcgggctccatcagtgaagccgatgcaaagaaaattgccctggaacaggtacccggagctaccgaaaacaatcttcggctcaaaaccgattatgatgacggaaggatgaaatacgaaataaagattgtctataatgaaataaaatatgaatttgatattgatgcggccaccggaaagatactggaatgggaatcagaatccatatatgactgattcctctatacccttacttctttgccgccgccccaaaaatctccctgcctgtattttcccgcagacagggggattttcttttctctccccttgtgttattgcttctgcaaatatggtaacataagtctgatgaccacataacaaatatttccgcaccattaaaaagacatttcataacacagtccttgcccggaaagaggaaatttattatgataaatttttacgaaaagaggcggcaccatgatcaatatagcaatttgtgatgatgaagaattcatgtctgatgaattatccggtttactttatgagtttttttctcccaaaaatatagaaattaaaatttgtcaatttacaaacggcagcgccctgctgaagtccaataaacctttggatctcatttttcttgatatccggatgaacgggacaaacggcatggatgtggcgaggatattacgcagcagaaattataaaggctattttatatttgttaccgttatggaggagcttgtattcgattcctttgaagtacaggcatttgattattttgtaaagccggttaaccatgagcggttccataaaaccatggagcgcttactttccgttatgcagaattcttctgaaacaaacctttttatacaaagaggaaatgaatggagtattattccctttgatgacattatgtattgtgaaattatcaaccggaaaatttatctgcatttagaacggcaggaggttattgatttttatgaaaagattgaaaacatggaaaaaaaattagacaatcgttttttcaagtgtcacagaagctatataatcaatttaaagtatgtaaagaattacaaaaaagatacggcctatctatgcaatggggaagaaattcctgtctccagattacggaatgacgaatttaccaatgccatattgcagtacatgaaagaatggagattttgaatgcttgtctttattgattttttcaatatttttatagttggtttcgctgaaaatatcatagaactttatttttttgcaaaattaaatggtaagaaagcaaagctttcccattacatactgttatccgccataaacaattctttcataaatttagtgcctgcagccctgcctgcaaaattgttgattaacgctgtattactggtgtttttcggtgtttttatttataaggcgggcatcaaaactgctgtcctgtatactattatcatcgttgaagttatggaattatgctttggtatttttaattcgttaaccggaattttatcaccattgctttatccggtaaatccgaaggctgtcggcctgatttttatgattataaacagtttttgctcattgctgctgtcctgcctttgctattctgttattcataaatattttgtatattcggaaaccgaaaaaaaccggtatatacttatgcttttcatgccgcttctaatgatactcatgttaagtgaatttataagcaattccgtttacagcaacacaattgtactcagccgaagaggggagatgaacaatacaaaccatctacagatgcttgtcattcaaggcttcggtattttaagcctgttctgcattatctatgtcttccaaaaattgattcacagcttcagaatcaatatgcagctgtctatgctggagcaggaaaactaccatcagaagcaatatgtatcagaggcaaaatcaaggtatgaaaagacacaatccttccggcatgatataaaaaatcatctttctgtcattcacggtcttttagaaaaaggagagattaaaaaagcagaagaatatttggaaaatatggaaaccttgatggatggtttatccttcccctgccataccaataatccggttcttgatattcttatcggcaacaaactgggaatcgcagaagataagggaattgctgtttcctgctccttaaaacttccttatccatgtaccataacagacatagacctatgtattatattgtctaacgcattagacaatgcgattcatggatgtgagaaaacagcagcaaatcccgacaaatatattgagctttcaggacatatgcagggagacttccttttacttgaaataaagaacagttactatggaaaagctccattgaaaaaaggaattggtttatccaatatcaaatccattgctgataaatataacggggccatgagtataaacacccataaagaatccttttgtctgaatgtgctgctcatcattccacaacaggaagaaaacatttcacgtcaaaggtattgaatcatccgttctgaggcttaaaatacaggaaaaggaggtaatcgccatggaaacaggtgtaatacagaacagtaccgtctttcaaaaaaatccatcggagccggctatggcatcccctgtccgctctcttgaggacagggataacacagataaaccggcttccctcccatcaccgcatgatgaatatatcaaaagtgaaaactcttcagatacagcaagcggcctatacaaggttgttccggacgagaatggcagctataaaattttatatgatgatcccaaagcggaagcttcaaaaagttcagaagaggaatgtactgttaataccgataaggctgaccgcgaaatagaaaaattaaaagaaaagaaggaacaattggaacagcaaatcaactccgcttccggtgacgagggtaaggtaagggaactggagaagaaactggctgccgtagaaaaagaactggcccaaaaagataatgacgcatacagacgtcaaaatgccgtaatttcataaaacaatactttccccggaaatataaaaatcatgtatcctgggaaaaggaaggctcctgcccgcattccgcctgcagacaggagccttttttctgtaattttccgatattctcttatttttccggagaaataatatatttccccttcgcccgcagctgaggctggctcaggatatcgcccagccggtccagcccgcagacatcatagatcatgctgctcacatccagacatcccgaatcaatcaaatccagcgctcttttctgtgtataaggattaatataggaagccttgagtacaagctctttctggaaaatctgaaaaggcttaacagcaatggtttcttccggtttggtaagcccgaacatcatcaccaccgctttcttccccgcaatttcaattgcctgttcaatggttgacggacggcccacgcattcaatcaccgtctgcacccaattcatccccgctccggccagcgccgcctttacatcttcattgacaggatcgatgcagatatccgcacccagcttctttcccacctcgcgctttccttccacaggctccagcagcgccaccttagccgctccggccagcttggcaagctgcaccatgagaagcccgatcatgcctccgccgattaccaccacctgatgtcccggccggatttcacacatatccaggccatgcagacagcatgccacaggctcggccatagccccctgttcaaaggttgtattttctcccagccggtaaacctgcctgtaattaaccgcgcaatactcagcaaagccgccgtttaccgtcgtgccatagcctatcatatgttcacagaaatgagcctccccgttccggcaggcatcacaggcgccgcagtaacagttgggatcgatgcaaaccctgtcaccggccctgtactccgtgaccttgtcgcctgtcttcaccaccacgccggaaacttcatgccccagaatggtcggcggcgtcacctccgcggcccccttgtccccttcataaatatgtacgtccgttccgcatataccgcaggccttcacctgaatcaatacgtcctccggccccacttcgggctgcgcatactcttccactcttaaatcatgttttccataaaacactgcacttttcatgcttatcccctttcctgtcccctctacatttactcctgtaaattaatcccaccgctccggcagaagctcatccagcgtaagcacttttcccttcagccgtatccggcaggataaattatcatggttgatctgatacataaactcccggcatcttccgcagggcggaacaattcctgcatcctggcttaccgccacaagcttcacaatccggctttcccctgcagtaaccatggccgcaattgctgcatgctccgcacaaaagcccatggaacagggcgtatcaatgcatactcccctgtatacatttcccagatccgtgagaagggccgcagccacacttcctgcataagagctgtccgacagctcccttggatttaacgtacggtatgcaatgtccgttaactcatcaaattccatttgttttccttcctccacacctttccttttccgtcctccggtacttcataaaacctggcttttcaggaactccatcagcttttggttgacggaatcgtttctttttaccgcctccaggccttttcccagaatatcgggacattcgccgcagatatcaataccgataatggtgtgacagcggatcagcagccgcagaatcgcttccagcatggcaatactcatatttccctgatcccagtccgtgatctcctcctgggggcgaagcacgtccttgtcaatggatatgtatatcggcagcttcacatgctccccggcaaaagcctgccagtcctttgtcattcccaggaaatccgtggtaaagcacagcaggcgatcgcggtagtcttccccgatagcttccagggcatgcttatccatgccaatcatgactaccttccgcagaaaagggttcgtgtccagcgcatcctttacccaggaaccgcaggacagcagttccccgaagcgggacggctgcatatctgtatgatgatcaaacagaaccaacacaaaatcctcccggattttgtccgtccagaacttgcttatatagtggaaattaccggaatcgataaaatgcactcccatcggggacagattctctatccgctcccggatttccctgcccgcctcttcatcacaatatccgttcactcccttaagccccgtgaaatccatccacagatgaggttccttccggtaaaaatactcctgttcataaacatgggtaaaattcatcatcaccacaggcgcagctgcctgctgccatttcttttccctattccgcattttcactcccgtccggctcacacctcccttcccggccgcacatacataaggctatccggcaaggggatccttcctgttgaaaatttccacgttcaccgcattatcctgtttcgccacaatggtggtgcatactgcgtcccctgtaatgttcaccgcagtccttgtcatatccaggatcctgtcaatccccataatcagcccgattgcctcaaccggcagccctacggaattgaaaaccatggataaggttatcaggccgacgcttggcacgcctgccgttcctatggaagcgagcgtggctgtggctattaccgtgaggaaatccgccgcagacagatgaatatggaatgcctgtgccgcaaataccacggccactccctgcatgatagccgttccgtccatgttgatcgtagcccccaggggaatcgtaaaggaggatattttcttactcacccccattttcttatgaagggtatcaatagaaaggggaatggtcgcattggaggtcgcggtggaaaaggcaaacgccatgaccggggcaaattttttcaggaacttcaccgggctgagccctgtaaacagcttcagaagcacctgatataccacgagcccctgtaccgccagtgccaggaatacggcaaacatatatttcagcaggggaacgaaagcatccagccccaggcctgcaaaggttctggcgatgaggcagaacacccccacaggtgccagcttcatgactcccatcgtcatatccatcattatatcattaaactggctgaaaaaggaagaaaccgtatccgctttttctcccctgtgggccagaatgacaccaaggatcagggcaaaaagaataatgggcagcatttccccctctgccagtgcccccagagggttggtcgggataatatttaatatcgtatccacgatgctcgttttttccgcaatcaccgtttccgtcccctggattttccccaaatcaagccccagccccggattgatcaggccggcgaggaaaatcgccacactgatggccaccgccgtggtcagcaaataaaatccgatggttttcacgcccactctgcccagtcttttcgtatcgccgatagccatactgccgcagaccagggaacagaaaaccagaggaaccaccagcatctgcatcagccggatgaacccctgcccgatcacataaaaaatgccgttcacgatgacggtatccctgaaatacccctcaggaacccacagatttaataccaggccggtaaacgccccgcataataatgcaataaaaataaccgtagtgaggttctttttcttttttttcatttatccccattcctttaaagcatttttcatatattcttccagcgctgtctcccaggaaaccggaagctctatcccatcgagacggagcatcagattatccagcaccgcatacgaaggcctgccgttctccatatcctcatctcccgccgcgatttccgtattatttcccgcaagctccatgatcctccgggcgaactcatatctgctgcacatgccgccgcataccgcatgataaagcccgtaggcatccttttccagaagccggtaaataacctttgcaagctcttttgcactggtgggcgagcccatctggttttcctgcactctgatcaccttttgggtttccgcgcttttcagcagtctggtcacaaaattatccccgtttccgtaaacccaggagctgcggatgatcagatagcggggcgcaatggttttcacaaattcctctcccgccagcttggattttccatatacggaaaccggcgtgggcacggagaattcattataaggctcctccgcccttccatcgaaaatatcatccgtggaaatctgtaccatttccgcatgcacgcttcttgccgccacgcttaaatttctggccccaatggcattcaccttatatgccagatcactgttttcctcacaaaaagcaatgccgcagattccggcgcagttgatgatcacgtcggggcggttcatttccacataagcccgcacctcatccatattggtgatatccacctcatccctgtccgtcagcagcacatccagctccgtagtatccagcatccttgcaaatgcgctgcccacctgtccctgggcccctgtaatccaaatccgttcatgttgtaacagcattctgtttctcctcttttatctccgcccggatgcgttttcccgcagccggcgtcaggccccggcccatcgtttcggatggagttaaaagactcaggcgttatttgcatatcgtctgagtcctccgaagcccgacgtccgttaacccgggacgcacagcttttttcttatttcccatactgtatgggaaattgtaataatttattataaaaaaacaggctttttacgtcaactcctattttaagcttttccatttgtctcactttcctgaaaacgtatactgctagtatttaacttaattgctatttttatccgcctcaccgtgaaccggatcttgctttctctgtctgcttcacatgccatatcgccgaaaatctttccaaaatccggcctaaaaggcgaaaaaatgccgaaaaatttaaaaaatgcaaaaaagttatccttcctaatagaaactggtgtataatacaaccaaattgttcagaaagacagatgtgtttctgtcacagacaattgttcacgacactaataaatgaggaggaactaattatgaaaaaggcacttagtatcttttgcgcagctgctatgtgtaccggtatccttgcaggatgcggaaacacaggatccactgccgagactactccggctgcccccgcagaatccgtacaggctgattcacaagctgcggaaactcctgcggcagatgctgcagacaatgcagacaacacagccgccggcggagttttcaaaatcggcggtacggcaccgctcacaggagccgctgctatttacggcaacgctgttaaaaacggcgcgcagatcgcggtcgatgaaattaacgcagaaggcggagctgttcagtttgacctgaaatatgaagatgatgaaaacgatccggaaaaggcagtttccgcatacaatgccctgaaggactggggagtacagctttcactcggctccgttaccacaaaaccctgtgaggctacttccacagagcattttgcagaccgtatcttttccttaaccccttccgcatcttccacggctgttacggacggaaaagataacgtattccagatgtgcttcgcagatcccaaccagggtactgcatccgcagattacatttctgaaaagcagctgggtacaaagattgctgttatctatcgtaatgacgatgtttattccagcggaatttatgagaaattcaaggctcaggcagaatccaacggcctggaaattgtatccgccacaaccttcaccgatgcaagctccaacgatttctccgttcagctgggagatgctaaaaatgcaggagcggatcttctcttcctgcccatctattatcagcctgcatccctgattctgaagcaggcaagcgacatgggctacacccccaccgtattcggtgttgacggtatggacggtatcctgactctggaaggctttgatacctccctggcagaaggcgtaatgctgctgacccccttcaatgcagatgcggaagatgaaaaaacaaagagctttgtaagcaaatataaagagcagttcggcgacgttcccaaccagtttgcagcggatgcctatgactgtgtatacgcatacaagactgcccttgaaaattccggagcaacagccgatatgacggcagaggaactgtgcgaaaagatgatccagtcctttacctccatgacctttgacggactgacaggcgaaggcgtaacctgggattccaccggcgcagtttccaagagccctaagggtatgattatcgaaaacggcgcatatgtgggtctgtaattcaacggactgcccataatacaaataccgcaggggagcgcgctatcatcagcgataggttgctcccttgttccttttacagtcgttggtgcagggcggtagtctgccctgcggaccatcgccctgggccagcgacaccaagaaaaagtgaggtgtattccatgacctttttatcttatctgatcagcggcgtcagcctgggtagtatctatgctatcatcgcactcggttataccatggtttatggtatcgcaaaaatgctgaattttgcccacggcgatgtcatcatggtgggggcatatatttccttctgcaccaccagctatctgggcctttccccttttatatccgtgctgttttccattattgtctgcaccgccctgggcattgttgtggagcggctggcatacaagcccttgcggaaggcgccttccctggccgtactcattacagccatcggcgtatcttactttctgcagaatgcagccctgctgatatggggatccagccccaaaaccttttcttccgtagtagggaactggtctctgaagctttttgacggagagctgaccatttccggtgtcaccattgtcaccgtattggcctgtatcgttatcatgatagccctgaccctgttcactaccaaaaccaagacaggaaccgccatgcgtgccgtatccgaggataagggcgccgcacagctcatgggaatcagcgttaactccaccatttccataacctttgccataggctccggactcgcggctattgccggcgtgcttttatgttccgcttaccccacccttatgcccactacaggctccatgccgggcatcaaggcttttaccgctgctgtcttcggcggtatcggctccattcccggggctatgctgggcggtatccttctgggtatcatagaaatctttgccaaggcttatatttccacccagctttccgatgctgtggtttttgccatgctgatacttgtcctcatcgtcaagcctgacggcctgctgggcaaacatatcaatgagaaagtgtgaggtagatggtatgaaatctataaaaaaacggatggccggcaggcgtgacagcctgatttccttcggtattgttatcctcgcctacatcgtaatacagatcatgatatccaccggaaatatctcttcctccctgaagggacagcttgttcccatctgtgcctatattgtaatggcggtttccctaaacctgaccgtaggctttctgggcgagctgtcgctggggcatgcaggctttatgtccgtcggcgccttcaccggtatcgttgtgaccaccagccttgcccaggcgattccctccgcccctctccgtctggccatcgccatgatcatcggaggtatttttgccgctgtggccggcgttattgttggtgtgccggttttacgtctgaagggagactacctggctatcgtcacgcttgccttcggtgaaatcataaaaaacataatcaatgtgctttatatcggaatggacggcaaggggctccatttcagccttctggaacagcgcttcgccctggaggacgggggcaaaatgattatcaacgggcccatgggagtcagcggggttaccaaaatttcctcctttacttccggtattatccttatactcattaccctgttcctcatccttaacctggttcacagccggaccggacgcgccgtcatgtctgtgcgcgataaccgtatcgctgcagaaagtatcggtatttccgccacccgctaccggcttctggccttcgttatttccgcagcctttgccggtatggcaggcaccctgtatgccatgaatttttccacggtaacagcgaataaattcgacttcaacacctctatcctggtgcttgttttcgtcgttctcggcggtctgggcaatatctggggttccatcatagccgccgccctgcttacggttctgcctgagcttctgcgcggccttaacgattaccgcatgctcatttatgcaatcctgctgatcgtcatgatgatcttcaacaattccggcctgaaaacgcaccttctggaaaaaagagccgcacgccgcgccggtgacccgcagaaaaagaccgaattatccgataaggaggaggtataactatggcaatgcttgatgtgacaaaacttagcatctccttcggcggcctgcgggctgtagatgaattgaccatgcagattgaagaaggcggcctggtagggcttatcggccccaacggagccggtaaaaccaccgtgttcaacatgcttaccggcgtatatcttcccaccgaaggcggaatccgtctggacggaaaaaacctgataggcaaaaagcccgcggatatctgcaaaatgggcgttgcccgtacctttcagaatatccgccttttcccaaaactgtccgtactggataatgtaaaagccggactccataaccaggttacctactccctggcagaaagcatgctgcaccttggcggctattccaaaaaagaaaaggatatggatcaaagggcactggaaatcctcagtgtattcgggcttgacagctccgccaatgatttggcgtccaacctgccctacggcaaacagcgtaaactggaaatctcccgtgcgcttgccaccagccccaagcttctcctgctggatgagcctgccgccggtatgaatcccaacgaaaccggagaactgatggaaaccatcagccttgtccgtaaaaaatacggtgtgaccattcttctgatcgaacatgatatgaagctggtacagggtatctgcgaatacctgtatgtattgaacttcggcaaactgctggcagaaggaacgcctgcccaggtgctgaacgacccggcggtcatcaaggcctatctgggcgattaaaggaggtcttaatttatgtcaatgcttaccgtagaaaatctgaatgtatattatggcatgatccacgcattgaagggcctgtccttccatgtggaagaaggagaaatcgtcgccctcatcggggccaacggtgccggtaaaacaacgaccctgcagaccatcagcggtattctccaggccaaatccggctccgtcaatttccagggcaaagagataacctccgtccccggaaaccagattgtaaagctgggtatgtcccatgttccggaaggccggcgcatgttctccaatcttaccgtttatgaaaacctaatgatgggagcatatacccgcaaggataagaagcagatcgcagaaactctggaaaaggtatatgaacgtttcccccggctgcaggaacgtacccgccagctggcagggactctgtccggcggggaacagcagatgctggccatgggccgcgctcttatggcacagccccgtattatcctcatggatgaaccttccatgggcctgtctcccctgttcgtcaacgaaatttttaatatcatcactgaagttaacaagcagggcgttactatcctgcttgtggaacagaatgcgaaaaaagcgctttccatcgccaaccgcgcttatgtccttgaaaccggacgaatcgtcaatgaaggagacgcccatgcccttctcgatgacgaatccatcaaaaaagcctacctgggtgaatagtaaatcagatcgaagggggattttatatggagaaaataattattaccattgcccgccaatatggcagcggcggacgtactgtgggaaaaatgctggcagaacgcctgcagatcccatactatgaccgggaaatcatctcaatggcctccgaagacagcggcatcaatgccgccctgttccaggatgaaaaaaaagtacacagcctgcgcgccctgctgacgggcggatatcacagcaataagctgctctccccggaaagcgccggcttcacaaaagacgataacctgttcacctaccaggccaagattatccgccagctggcagaggaaggctcctgcgtcctgatcgggcgctgcgccgaccatgtcctgaaggaaatgcccggcgtggttcgtgtgtttgtccatgccccggcagacttctgcctccgggaggccatgaaggtcaacagccagcctgaaaatgaggtggtgaagctcattgccaaaacggacgactacagagctcgttattataagtactataccggaaaagaatggaaggatgccctgaattatgatctgtccctggacagctccaggttgggcttcgacggtactgtggaggcaatattggcctatattgaggtacgtaagaaattcgatccgcagatgcagggataacggtaatttttaaattcagagtataaattttacagcagccccggtcatgatttctcttcatgtccggggctgctggttagttttttagagaaagggatagtatcactatactttatccggagctattctacgctcaaattcctctattgtctcggcttttgcggctaatttcagccatttgctgaggatttcataatcatgctgatctactatcttttgccttaactgttctgagaccttccctgtttcttccaatagttccaaaatagaagccgcttttccttgttcaatgcctttttcgattccaatctcaagaatattcatcttcacagcctcccattcttccgattgcttcacttcattcactatcctgtccagactttgtattctcttatcctttacgattatttccggattatccatagtagtatttttcatgtactgcaggagactgattaattcaggccttccattcctgctcgtcatattcagaaaaatcttttttgttccgtcgtccagatgcagccccggtacttcttcacattgttctgtaaatgtatacatggctgaatcacatcggaatatatcatcgcgggtaataaaaataataattgtggacggcagatgtttatatttcgtcttctttcccgattttaacactggtgtatccagaagtccctgataaaaacgagatctctttcttaaattatcctgttttgcttcattctgcatttccgtattaatgtgacggttctgttcatcacgcgcccatgcatccagacgtatagcacgtttccctgatttattcaggactacctgctccacctttacctccttcagcctcagatccggctcatcaaggatgatgctcagagtgttttcgtaagctgtcttgttcttcataacagacagaaacagcgcaaaatcactcagattaaacgcataatcctccggcagggcctccagggttattttgttactgctatttccgttcataggcgttcctctctttcatttacgcagaaagaagacacgccgtttctcctccctgcttattttgttgtcagcaaggagttcatgcataaaacatgcattagataccgtccggcagttgattcactgctgcggcacggttcagaatctttcagaaaatcagatggggtgaattcattgcctgtataaattttagcataccaaaataagctatgcaacgatatttaaaacataattttattcaatatataattatcatacagcacagaaaccgcatataaagcagaaagctttattgcccttcttccgatacacctgtatactgtatgtagcagaaaagtacagcccttcaggaggacagcctatgatttatttcatggagaataatattgtcatacgcaggatgcaggaaacggatccgcagattttcagcgatgaagagtgtgcacaggactggcatgcttcgcctgaaaaatatgatatttcttgtaaaaaaagatgatggaactaaaataggcacctgtggatttcactgttggaacaaggaaaaatccagtgcagaagttggatatgacttaaaagaagcattttggggaaatggctatatgcaggaagcattgaaagaaataatagcatttgctgctaaaagtatgaatatcaagagaatagatgcagttatttatgtagaaaatcctaaatcaatttcagttgtagaacgattgggattatcctttgatggtaaaataaagaatgaaatttttagagattcggagtatttacatcgtatctattcgatttactgcacaaaatgagcataattcttgtgtttgactgcgcaatgctgctcttcccggaaagcgccggctttacaaaagacgataacctgttcacataccaggccaaaattatccgtcagctgggggaggaaggctcctgcgtcctgatcggacgctgcgccgaccatgtgctgaaggaaatgcccggcatggtccgtgtatttgtccatgccccggcagacttctgcctccgggaggccatgaaggtcaacagccagcctgaaaatgaggtggtgaagctcattgccgaaacggacactacagagctcgttattataagtactataccggaaaagaatggaagtatgccctggattatgatctccctggacagctccaggctgggcttcgatggtactgtggaggcaatattggcctatattgaggtacgtaagaaatccgatccgcagatgcaggattaacgggatatctgaaattatagagcataaatattacacagccccggccatgaattctcttcatgtccggggctgttggttggcttttagaaaaagggatattatcacgtagctttatcagtagctatcctacgctcaaattcctctatcgactcggcttttgcggacagcttcaaccatttgctgagggtttcagagtcatgctgatctaatatcttttgccttaactgttctgagaccttccctgtttcttccaacaattccaaaatagaagccgcttttcctttttcgattccaatctcaagaatattcatcttcacagcctcccattcttccgattgcttcacttcattcactatcctgtccagactttgtattctcttatcctttacgattatttccggattatccatagtcgtatttttcatgtactgcaggagactgattaattcaggccttccattcctgctcgtcatattcagaaaaatcttttttgttccgtcatccagatgcagccccggtacttcttcacattgttctgtaaatgtatacatggctgaatcacatcggaatatatcatcgcgggtaataaaaataatagttgtggacggcagatgtttatatttcgtcttctttcctgattttaataccggtgtatccagaagtccctgataaaaacgggatctctttcttaaattatcctgctttgcatcattctgcatttccgtattaatgtgacggttctgttcatcacgcgcccaggcatccagacgtatggcacgtttccctgattcattcaggactacctgttccacctttacttccttcagcttcagatccggctcatcaaggatgatgctcagagtgttttcataggctgtcttgttcttcataacagacagaaacagggcaaaatcactcaggttaaacgtataatcctccggcagggcctccaggattgttttgttactgctattttcgttcataggcgttcctctctttcatttacgcagaaagaagacacgccgtttctcctccctgcttattttgttgtcagcaaggagttcatgcataaaacatgcattagataccgtccggcagtcgattcactgctgcggcacggttcagaatctttcagaaaatcagatgggttgaattcattgcctatataaattttagcatatcaaaataagctatgcaacgatatttaaaacataattttatccaatatataattgtcgttactgtgcagtaaatgcactgtactgagtgaacagttactaattgtcatacagcacagaaacaccatataaagcagaaagctttattgcccttcctccgatacacctgtatactgtatgtagcagaaaagtacagcccttcaggaggacagcctatgatttatttcatggagaataatattgtcatacgcaggatgcaggatacggatccgcaaattttcagtaatgaagaatgtgcgcagggctggcattcttcgccccaaaaatatgatatgcgcatttcagatgaaaaaaagggaatctctgtcgcacttacagcagaatatcagaatcatcctgccggctatataaatgtatactggaattgtaccgccggatcttttgcagataaaaacattcctgaaatagtggatttcggcgttctggaaaaataccgcaataaaggaatcggaggtctgcttatggatacggcagaaaaaatagtacttacccgttccaaaattgtatgtattggagtcggccttcatgcagggtatggcagtgcccagcgcatgtatgtaaaaagaggatacataccggatggctcaggggtatggtatcgggatcagatttgtacgccatatggtgattgctgtaacgatgatgacctggttttatatttgagcaaggaactggactgattatagaaaactgcattgattttgtaacgttaaaaatattatactgtaaaattctttcaaaaaactgactatttttcacattaagaaaactaaaacaaaaaagtcaaaatcataggagataaaatgataggaatatatgattgctttggctatggtacaggttatgaagtgtcatttgaagaaagatataagttgataaaaaatgccggttttgattgtgtgatgctctggtggagtgataaatttggcagaggtatggggtatcagaaagatgttcaatttgcaaggaaggcaggattacttatagaaaatatccatacaccagttcatgaacaaaactgtttatctttagataatttggatggagatagtgtatttcaatcttatttacaatgtgtaaaagattgctttgaatataatataccgacaatggttattcatttgccaaatgatgagagtccaataaacaatttaggtatcaaaagactggaaaagattattagcgaggccgaaaagctggatgtcaaaattgcctttgaaaatctgagtaatattgaaaatctggctttagtattaggtgtattccactcaaagaatgtagggttttgttatgatagctgccatcatatgaattacgcacctaaagatgatttactgaaacgatatggaaagcgattaatggcattgcacttgcaagataatggcggaaagcgtaatcaacatcaattgccgtttgatgggaatatagattgggttaatgttatgaaagcaatagcacttactggttatcaaggtgccacaacattggaacctatgaattgggattatgagaacctgtcaatacagcagtttttaaacttagcttatcaaaaagcgaaaaaaattgatgagatgagaatggcataaactttaatttttttatagtttaggagatttccaataagtaagaatcacaattatcgccgcagtgataagtatgcttctcattgtctagcctgcggcgcaaaatgatacccagctttacaaaatatttttgctgtataaccaataaaaaatatactttataagaggataaaaatgttacttaatcaaatctatcattcagagatacctttatttctcagggaattctcagccacagatgcattgctgcgcctgaagtcaataggtatggactgcggttgtgagtatactaattttccggcatataaacatagtataaaatataaccgttatgaacacagtctgggcacggctctcattatatggcatttttctatggatatgaaacagtctgttgcaggactgttacatgatatcagtacacctgttttctctcattcgattgattttttaaacaacgactatcttcttcaggaatccacagaagaagatacagaaaaaataatttatcaatctggtcagcttatgcagttactaaaaaaatatgcaatttccttggaggaggtctgtaattaccatatatatcccatagcggataataattccccaaagctgtcggctgacaggctggaatattcgtttcgaaaatttcagagtttcggtttaaaatcattaaatgatattatttcttattattcggatcttatcattgggatgaatgaagatcaggaaaatgaaattatgtttacatcttcagaacttgcattggacttttctttatgttctctgaaaaattcaataaatgacgtatctgatgatgatcgcttcgctatgaaattccttgcagatattctccattatgcattaaatagagaaattcttacccgggaagatttatataccactgaatcccaggttatatctaaattaatgtcggttcaggaaacaagaaaagcctgggaaatatttagaaatctttcccatacaaaacgtactttagataatcccttccataacaattctcttcctcaaaacattgtcccatcccctttttctcagtcagatttatcgccttcacctggttggataactctgtccgctaaaaaacgatacattaatccctacgtccaatcccacggacgtataatggaaatatcagataaactaaatcaggagatacaaaaatttcttgacctgaaaatggattattggataacagccacaacagatattccatagtttactatagaataatctactcataacaatgtcacaaaatcagcaatttagctcgccagatttcttcttggtttttctttacttttttcaatttactgatatagtcatgctttgcaaccctcagttgactaaatatacggtactgcttctggaatgcaaccacagcttttgttatcctgaaaccaccaaaaaggaggtactaatcatggatatttcagaaaaaatcttaaaattacgaaaggcaaacaatttaacgcaggagcagctggcggaacagcttcaggtttccagacaggcggtgtccaaatgggaatcaggtcaggctatccccgaatcagataagctgccggctctgagcgacttatttcatgtaaccattgactacctgctgaggccgtccgagattgatgagctttccattaaaacggaaatcctggaaaaacaacagaaagaaatcatacgaaaggaacggaagaaagatactttttaccattgcttattcagctgtctggcaatttatcttgtaacctttgccgtttatttaatcggtcatttttattttgaaatctggaatccttccgttatttttgctgaatttctgattgcaacagctattgcaatctttgtatgtctccgattccgcagtaataatgcgaaagaatgcgagtaaaattttcttaatcgggaaaagttccccgcggatttgaaatacgattgactaaaggccattgatacacaaaatcagtcaacaaaatcaatcaaactcaaaaatcgtttcctcctgtgagcacaatggtgtataataaatgttggtacgaatctttctgcaaaggacagattttcgttgagataccaattaccaggaggaaacatatgctgaaacaattatcaatttatgccgagaacagaaaatctactttaaaaaatattaccggaatcctggaagctgagcagattaatatcctcggctccgttacaaacgacagtgcggaatacggcattgtccgcatggtagtgtccgaaccggataaagccgcacaggctttggaaaaggaaggctatctatgtaagcttaccgacgtgaccggagtggaagtagccgacgaaatcgggaatctgcatcatctcctgcaggcgctttcggaaagcaatattaatgtggattatgtttatttatcctttaaccggaactccggaaaaccaatcctcattttccacacagatgatatcactgaagtagaggcttgtctgaccacaaaaggatttattgtggtacaagaagggcgtttctgacatacttttatcgttaaataattaagccatacttatgaggtatatgccataccattcctttcacgataaaaatcgccttgctgcagcagcaagacgatttttttaattttctctatcacagggcggctcataaaatgtctcaatatccacatatctattatccaattgactttcataagacatccaatccgtgaaaagatcacattcaccgtattcatggagcctatactgtaaattcagaagcattctctcatgaacatcaaaattgatgggggccatttccaccatatctccatattctctatgcattccatatccctgtctggccttgcttctcaggaaaaataaattctttgcataatattcttttaaatccgccaaatcagataccgtctctccattataattgagcttatcggagaaaaaatattcttcatcgtttataatccgttttcttatttcgtacaggttcagtacttctcccgaagaatcgcagcaatagcttccataggtaggatcaagcattatccatttattccattccgcaataaaagcctccgccaccacatggttatccccgtcatctgctgccttaggtatcatatataccactcttgcataaatccccgatgccagaagacattcggacagaattatggacattgacagacagttaatcccggtattatcctttttataagccagagtgagtaaatgcagggcatcctgaggatccgaattatcataatttcctttatgtcttatgttcttattcacccattccaacagatttaccgcctgtaaaaacgtgctgccctttccggcagtttcatgaatcccatattctttttccaggctttcatattctttgcagctgaatgcatacttaatctcagccggatagtctgagcgaaagctttgattttctcttaacagcgccggataatccatccccataactattgcccgcctttctgcttatttcctgtcagctcaattgtaacacagcagggaaggccgcacaattgcagaatatatcaaagcgcaaggcataataaatgctttttttctgtactctcaaatactcactctataatcctcacatcctgactgtccgaaaccaatatagcctgccggttgtcaatccgtatctccccgcagttttccacgtctgcaggcccggcctccatccccttttcacaatgcacccgaacaggacattcaagtatacccaggctgcccttcaaatttcctgccgccgccaggcttccggcactcaccccgacatatacaccgccctgcttaataaagaaaagcagtgtattccgaaaccccttttcgtttattcgctccagaagatattccgtattacccccgcagacatagaccgcatcatatcccatcagttcctcccggctcatatccgcatgaagatcatatacccggatattatccttaggtatcccgcaatccagcagatcatgcagacatttgggaagcacttcaatcgcgtccgcgtcaatagccgcagcaggtataaaaaccgcttttatatcctccggttttttccccgttaaagcaagaaatgtttcttcaatccttttattctcaaatccggctgaagtcaataatactttcatacctgcctctcctccctatcggctctccctttcattccggccagttcatctgttcctttgcaacgccccgtttttcacattccctgcatactctttccttatccggaagattcccgatttcatatcggagcaccagcccgttaaatactatatacttcatatttcctgatttaaaatctgcaaaccaggcttccccgccgtctgtccctcccgacagtgccccagacagcagttccgggaaatcaggacgggaggaagtaaaatagatggccgtccaatacttcggagcccctcccgcattccagatttctactttattcatggatacggcatccagaatctcatcccgatcaaggctctctttgatgattatcccctcatagattccggattccgcatcatttatggcatttaatccacaggtgccggtctttttcaccccgttaaccacaagttcatcttttaaaagaacatccagagaaacctgaaacgtatttgcaagaagcaacagcctgtccgtttcaggcagcgctatatctgcctcccatttggaaatggattgtctgctgactttacagatttctgccagttcctcctgggaaagccctttctctttacgcagctgttgtattttttctgatagcttcaatgttttatccccctttctttttcttattataaagtaaatcttcagattttccaccaattgcagagtgcatttatgcaaccgggaagtgaccggcggcaggcatttcctatggctgacggatttctttgtacgaaaaaagcgctccgcagagcgcctttcagacttactaacaatatcccagctgggaaagaatattttttggctggtcaataaaaaccatatccgcattgtcatccaggaaatgtctttctttatgaatcataataagccattttccatgaaaatatttaagataatgggcaaatacctccgaattcagtgtggttcccaaaagcagcagtacctgcgcatcatgaatcgcctgcgaagcctgtgaaatcagatgcggatccgtcatttcaccgaaaaagaacagaccgggacgtatgggaatgccgcacttctcgcatgccggaattcctttcacgtgcttaatatattccacagaatattccctcccgcagcggaggcagtaattgtgataaatacttccgtgaagatctatcacatttttacagcctgccctctggcttaattcgtaaatgttgctgctgatcacgcactgcagctttcccgcctgttccattgccgctaaaactcgtcctgaatctgtgggttccggcgcatttataatcatttcctctttgtaaaaatcaaaaaactgcttcggacgggtatggtaaaaagcgctggtgaaaatctcttccggcgaatgaccatatttcttttctatatcataggctttatccgcatattttactccgacaaatcccccttcttccatcatcccggatccgcataaagcaaccgtatagctgctttcatccagaattcttcttaaaatggctattctatcatccacttattacctcccggggaattccattccacctgttgcttgctaatgaatacttctgactgggttattatataattatttccccaattttactattcataacacggaaatggaaaaaactgctttagccttcgccgtttcctcccctctttttttccagctcccagaaaaggaacagggggattttctgcagccagtcgagaccgggaaatttttttatctgattttgtgttgggatcggttccgttaagtcagtgaccgaaaagccgcatgcaacgaaggacttcacgtaatcctgaagtgtcctgtgcctccatattacaggcttatccacatccttatataaggctctttcccataaaacgggatgaaaataatcctcaaccgtcactttcttttccgtatcatctccgctccaggttatttcctttccataaaaacaggggtgcagaacgctggcgacaagctttcctcccggtttcagcacgcgcatgatttctctgagcgtaccctgcagatcttcacagtccataagcatcatggaacaaagcactctgtcaaagctctcttccggaattccataaagatcgtcgctgttccgcacaaaatgcctgatgtccagacattcctccagggccttttcagccgcatattcaatgaaaaaggaagaagagtccacagagtatactctggccccggctgcggccagttcccgggaataaccgccttcaccacagcccaaatccagtatatccattcctcttacatctcccagatattccagtgtatagggcataataaaaaacatcctgaaatcgttggactgagcaagggcaatccactcttcatcttcctgtttccacccgatagcagagctgtcctgacgcataattctctcctttcacatataattctgcagctatatatttgatttctgtcttttctctggcagggatataccggtacttctgatttgccggatatcctgccataagagttccatataccttacagccttccggaatttccagaaactccccgcattccggcagaaaattgagcaaacgggtaagatagctaaacttatgaagaagaagaggaactggaagcagccgctgccgctgcaacagcagcgcacatcgcagcctgctgtgccacaatcatggatatagtcccgttaattgccgccgtctgcagcgtatttctttccagatattcagcctgcacaagcattcccgcatacatcagacgctggcgttttcctacgccgaaagcgccgaagcccttctgcccggccaggaaatcatccgcttccatcatatcacttacgatatcccttacatccccttccgacaaagcaagaacccctaatgtaggcagttcatagctggtgccatatttatagcctctctctttcagcctatcaaacaaggccagagtcttactgcatttttctgccgccatcccatctcccaatgcaagtacctgacttaaggactgaactgcatttccggaaaagaaattaggctttaatatctcataacactgctccataccagtgatcaactgttcattcggcttctgcgacagagagagaagcgcggcaaaggcactgtcctctccggatgtcagcataggatgatttgccttcatctctttgtaaatttcttttgtccgccgggcaatatattcgtaattctgctcctccgcaagctgtgcaattgccacagcggctaccggaagataatgggaagccataaagttctccttcaaaagctcatatacccgcagtgtccgggccaatgcggcatccggttcttcactcactgccataatggatactaccggaagcttaataatgctgcggaaaccggagaacacacctgtctgctgcttcaaaatccccacacaattcttcagcagtgctccctccgcctctttttcgtttaaggtaaaaatagcggcacaaaggggatacagataagcgttttcccatccgaagttttccttgattctgtctctgttgcgtataaactgctcacatcttgtctgaatactgtctttcatacacactccttgtctgcgtctgcgcgccactcttcttttaacattccatattcataagtatcctgccataaaggctcccctgcttcatcgcagaaaaaataaatattccggataagcgtcccttccctcctgaagcccagacgttccaataatttccaggaagactgattctgaggattgcacatggcaacaagccttcttgctccccactcttcaaaagcctgggtaatcagggctgcagcgctttcataggcatacccgttcccccagaaatcgctgttaaatacgtatcccagctcccaggtatcataatcgcctttggacaaatacagattcccgattaccttacctgatttcagggcaaccgcataaaaattgggatcctccgccctgcgggccgcctcttctgccgccgcctgtcgggaatacagggtatagggctcatattttaccacctcttccctggaaagataatcatataaatcccctttatcttcctcagaaaaatatctgataataagacgttctgtttccagcagcataaattaagtctccttttctcacaatatccatgcgacaagcaaaagaatacaggctgtttttactcatagaaagaaaacgcatacagcagcgccagcatggacaccccgcaatgtatttctttatttttgagcatatacattatatcgccccttttcttccattttttacaatttacttcattttcatcaaataacttttcttccgacttgactttcgcgccgtaaatatgtatcagaagatccgacataccgttatttgggttctcactgcacagataaaccaactcctccagttcacatccggtttcctccatacattccctccgggccgcttcctccgggctctccccgtcttctatccttcccgcgggaatctcccattcaagctgtcctgtgatatatctcttggactgaatcataagaatttcgtccttatcattgcagatgactacacagactgattcatgcgggaagtgaagcctgtgataactatcgattatactgccgtccggcatttttaccttatcttcatataaggaaatccaatcgctctcataaatagttctgctggcaagtctttccggcatcatacgcattattctcctcttcctggcttattcattgactgcaaaatacgactgttgttctgctcttcaggttcttatcacaacactataatatatattcaaatacatcaaattcctgatttacctcatctatttctgctgaccattttgtaacacttcgaaaaccgcatttttcatataaacggcgggcgggaacatttttataatgcgtatccagcctaagcgtttttgctccggcctgacggcagtaatttattccatatgttatcatctgttctcccagtcccttctttctgtatgacgggttaacgactacagtatgcatgaccattacttctttatcatcacactgtattccccatgggattttcctgtattccggatgctgcttattatcaaggataaaggaaccctccggctttccgctaagcttaagaacaaataaagtatctttctgcagcgcctccagggcatcccttctgacaggatattttcccttttgccaattgggaaaacaataatttacattatctgaaaaatatgtattcaccgcatcatataattctgaaatagaatcaatatcctccgatactgctttggtaatcactgttttttccattctgttttctccgttcttcctatactgaaacccaaatgggaaaagaaaatatgataaaatattacacgccccgtgacttcaaatcccggtcttcttcttccctggcagccgcatgggcttcttccaaatctataccataacaatccgcaatacggatgagctgaccgaatatatcagccagttcgttccctatatttttttccagccccacaggcctttctcccttgtatgcataatattcctctttcaacatgatacatttggataaatctcccacctgtttgctcagttcgatcattgccccgtttactccccacggctttccttccaccttctcaaacctgtggtatatccctctgtaaagttcaattgcttcctgaaatgacattcccataccgataaacctccttatttttttattatatatccattatcactaaggacctgcagtgtgtcctcaaagttttctttttttgtaagtatgtaatctgtgttatatgtggatatcgcaaaaacccctattttattatctgccagaagggtcgttatccgggacaggatgccaatcagggaaaaatcaagaacaccctgtatcctgaaggccttccatccgtcatcacggctaagggtattgtccggcacagattcagtgctgcatacaagagacagttcctcatccgttttcccgataaaaatgtaatcgtcttcaaactttatttgtgataaattctccggtttacaaatggaaaaatcctgatctataactttaatttccaattcagacacccctttccttattttcggttccttgctccggatacagagtctctatatactccacaggaaccttttgggtcagccagacctgattttgggacagataaaatttatacccggcatcccgcattcttccggcgtaaattttcaatactaccggttttccatgtcgttttccaacgtttaccgccgtttccgttgtggagcttaagtgaacatatatgcggctccggccggtaagtccttcctccataatggcatttaaaaagcgatcggccgttccgtgatacaaaatctctggaggctccgcttcctttaattccacatccaccggaacggaatgtccctgattcgcacggattcggactcctgcctcatcataggaatatcttcccttctcatccgttctcactatttctgaaagacactcttcattaaattccggccattctttttttaatgtatgaatcacttcggtgaccggggcccatccatgttcatcaatgaaatctttatcatgtctcagtaaataagacaattttttgcttgctcttgtcatatccatatatttattcctcattttctatttttcgtcacctattttattttttcctatacataaaaagcagcacatgtgtaatgacttttgctcccgccatagttcacttatccgctccaccccaaaccgcctactgatttaggcctattatacactatttcgttcaagaaaggaaattcattcgattcatacttctttccgttcttcactaataaatattggaagacatcttttccataaaaaaatcttcttttcattactatgacatactgttgtcacactttatccggtataataaagctaaatactccagccgaaaactatattcacacaagaaaggatcctggtaaaaaactatgcttactctcacaaacaaacaagcacgtcaatttatcctcctgaaacacgggctgcttggcacccacaagttcgtcggaaaacagggcgcgctggaatttgtgcgccaggccggctgcatccaattcgatccggttgattcctgcggcaaaaacgcggagcttaccctgcagtcccgtgtcaacaatttcaccaaacaaacactgtccgaactgctttatacggatagaagcctggtcgattttcccgacaaaaatctctccatctttacgaccgaagactggccctatttccagcgctaccgtcaggctgcaaaggatggcggcaggaattttccggaactggaagaactggaaaagcaggcgatagaatatatccgtataaacggagccgtaagctctgatgatttacccatgcagggcagcatacactggcattcctccattcactggagcggtgtctggaacggaaataccaatgccgcaagggccgtattggaacagctctattccacaggcatactcatcatccatcacaaaaacggaagcaggaaatattatgatctggccgataaatacctgcccgcacagcttttggattcccctgatcccctgccggatgactttgcacataaaaaatggcgtgtcctgcgccgtataggggctgtcgggcttctatggaaccgtccgtcagatgcatggctgaacatctgggatatgaaatcaccggaacggattcagatcttcaaagaactgctttccgaaggaaaaattcttgccgttcaggtggaaggtatttccgccgaactgtattaccgcgccgaggatcaccctcttctggaaacagtccttgaaaaccgggattacaaaccacgctgcgaatttctcgcgcctctggactgcttcctgtgggacagaaaactgataaaggccttattcggctttgaatattcctgggaaatttatacgcctgcctccaaacgcaagtatggcttttacgtacttcccatcttatatggcgaccgctttgccggccgtatagaagcggtctgccagtcgaaaaccaacgtactgctggtcaaaaatatatggtatgaagatggcgtcaggcagactaaaaagctgctgtcagaaataaataaaaccctgaaacgctttgcccgcttcaaccaatgcgacagcattcagtttgaaacgcctgaccgccaggaactttcctgataggaaatatttttctttcccaatattactgcccatcgcttctcatacccggctgtttccggtatgattagtataaaagggggtagcattatgaaaatcctgttagcagaaaatatacgtttcttccgcaaagcgtccgggctgactcaggagcagctggcggaggccatggatgtcaccgtgggcgccgtctccaaatgggaaagtggcgccactacgcctgatctttcttccatactggagcttgcggccctatttgccgtttctgtggatgtactgctcggttatcagctgcaaaatacagatgcccggcagctggcagaaaaaatccactcgctgatgctggataaaagctatgaggaagcccttcgggaatcacaaaaagctctttcgaaatatccgaatcacttcgatatcgtctaccgctccgctgatttatatcatacagtggggatggaacgaaggaatcatgagctccttcatcaggcccgcgggttattggaacacagtctccggcttctggatcaaaataccaatgctcaaattgatgaagccgtaatccagattcaaattgcaaagctctatgccgccgcaggggaaacagaccgtgccattgcccattacaaaaagcacaattatgccggaataaataacgggcgcatcggcgccctcctttcctctgcaggctgctatgaagaggcacagccctacctttctgcttctgcactggatcaaatcacagaactgatccaggtaaccaccggtatgtctgcctgtgccgctcaaaccggcagtccctctgaagcatttcaggtattgagctggatgcggcagattcttgatggtctaaaaattcccggcaaagtctgctatcttgataaagcagatgtgtttctgcttcatctgcaggcgcagctttacgcagacgccggagatctgcccgccgcaaaagactgtctgcaaaaggcagtccggaccgcccgtcgtttcgatgccgcgcccgtctataccatgaaaaatatccgtttttatcatgagaaagaccccctgctcctttccgacagcttcggcgaaacagccatgcaggggctggaaaacagcatcctccacggaaccgctgaaggcactcaaatactgcgtgagatctggagggaaatcataaatgaatccgaatgacaggaaacaacggcgcagggctcttacccggtgctttttcttccataaccacacagctgcttttctggccatgtccgcagtaatactgaatattccgctgaacctggccgttgcctgtcagatgcagcagctgattgatatcgctgcaggctctccttccgcctttacccttccccggatcagcgctgccctggctctgtcctttgccgtaatggcggcaattatggctcttggcagctatgcccgcccgcttttcatagaacgagcggttcggcaataccgcgattacgcctttgaacagctcaccctgaaaagcacagccgcttttcataccgagaatacctccgcctatctttcagccctgacaaatgataccgtaagcattgagactaattatctgccctccctgttcacgctacccggtaatttactgatgcttatcagttcttttgccctgatgctttattacagtattcccctgactctggccgccgctgctgcagccctgctgccgctcgccgcgtctctgatggccggcagccgtctgtcttttcaagagaaaaaggtatcggaccagaacgaaagcttcatgtccgccctacaggatattctgttgggctttccagtcataaagagcttcaaagcccaaccggaagctatccggcttttttccctccgcaatgctgccagcctgaaaagcaaatgcagcgccagccggacaagaattattctgcagaatatttgtgctgccgccggacagctggcattattcctcgtttttatgctgggtgcacttctcgcaataaagggatatggcgttaccgccggtgtggttttagtattcgtacagttaatggataccgcggaatcctccatatcacagcttccccaaatctgggcaaaccgcagttctgccaatgctctgattgacaagctggcagccgccttatcctgcagcaaagaacaggatgggactcctgcaccacatacgcttcaggactccataaccttacaaaacctgagtttttcctacacgccggaaatacctgtgctgcaaaatatcacctactgttttgactccggcaaaaaatatgccattgtcggcaattccggcagcggaaaatcaaccctgctggagctccttcagggaagctattcaggctatcagggacagatccggtatgacggcagggagctgcgctccttcaggccggattccctgtataaccttatttccgtcatacagcagaacgtgtttctctttaacagctccatcctggataatatcaccatgttccgtaattttcccgaagaaaaaacagcgcttgccgtccgccgcgccgggctggaatcccttcttgctgcccggggtgccaataccccgtgcggagaaaacggaagttctctctccggcggtgagcggcagcgcatttccatagcccgatgcctgctgcaaagcacacctgtattattggccgatgaagccacagcatcgctggattccgccaccgcctttgaaataacctcctccatcctgtcactggacggaatcacccggatacttgtcacacaccgcctggaggaacctcttctccgccatttcgacgaaatcctggtattaaaggatggacgactgacagagcatggttcctttgacagccttatggaaaataaagcttatttttattccctgtttaccatatcccagtaaattgcaatatgatataatcttctaaaggttttcaacagagggttggaatacttcacagaaaggaatcgtggaaaatgatccgaatcggcagaggtggtttatggaataacagctataaggacgaaattgttttttgcaaaaagaatcattttgactttatacaaatatggtttaaagatggggaactgcttgtaaatgaccttccgtcccccaaagaagaatatattaaaaaagccgggttccctgtcatccttcatgcgcttttcgagcctgacgattttgaacgatacgggaaccagctgctggatttggtttccttcttcggagacaaggaagtgattgtacatcctgtctgcaaaaagaaagctgtggatcagcgaacagagtatgagctggctgaacatgtactggatttttctcaaaaagccaaagcaagaggtattctctggtatctggaaaacaacagtgttttagatatctttcattataaaaaagaagatcttgaaatagtttataaagccgattcctatgtggaacaactgctggatatcgcccacattgataactatcagcacctggaagatatcatatccgttaaattccccaggtgccttcacgccgccggaaaacattttgccgtccctcatgagcatctgcccttaacctgcggagatattgactacaagcttgtttttcagaaatatttgcatggatacagcggccggatcatacttgaggtggatggaagcggcgaagaaatggaagcctccaagcggatactggatgaggcggttttatatgcgtgacctttaatttactatataatcaatcacatacttagttaaatacatattttaggttaccttttacagtccctttgtgcctagtctgccttgcagactctctgtcgggtattacgctccactcaggaacttcgttttctgtagggaaggtggacaccatagaactatattctctctcttttactgaattcctgcctgccgctgtaaacaattttatttcatgcagatatgtatccagattggaatctaaggctctttcctagctataggcagagtttgaaaagaacgagaaataatgtcagcaagaaaaggaaaaaacgtgaaagcggtgttgatcttttttagttgactctattatcgataaaacatataatatgattgaacttaatagacatttttatttaggaagggatacaaagaaggcagaaacattggaagaatatagataattacaaatgatagaacaaaacataccaagcaatattattaaacagtttaccggaaattccgatgaagtatttggactcaatcaagaaatgtatgataaattttagataccaataatcagactgagtatttatagcttgaaaagggaaatggagtatagatggcaaatgataataccatcttgatttatcaggatgaaaatgaaataacaaaaatatcagttcgatttgctgatgaagatttgtggcttacccaaaatcaactggctgaaatctatgatacgacgcagcagaatatcagccagcatattgaaggtatttatcaggataaggaactcgatagaaaagcaactaacaagaaattcttgttagttcgaaatgagaatgttggaaagtgattttgacagagttgtgaagcaacttatgaaaaaagataagtaaatttatttgtccctaaattgaataaattctgtaacaattaagcaggtgcggacagttatcctccttctgtccgcagctgctctcatttaataaaaaccttctgggagcagcagtttcctccccgcagaaaggtttccaccagttcaaccctgaccggccgttcaaaaatggtactccatatcttctgatgaaagcccagcgtacagttacagaaaaccggcgaatgaacataacccgctctcacaatagaacagtcacagccttttcccctgttataggtcaataaaaaaccgtcctcctccggcacacattccgcacccgtgtgccggctgataatacgcgcaatctcttccatccgctcaaccccggccaattcttctttcagtccttccatacccggaagcgcatttctctccgcacagtgccctccgcattttttcagtaatccctggcaaatctcctggttttcattgctgctgatttcgcccagcaaatcttctagccaattacccatttcatccataaaacagtttcctcccgattaaaatacttttataaatgtaccataaaacagttcctctttatcgttttaaaaatacttatcataatctccctgcaaaattgccccttccagccctgccactctcggccaaagcccggtttccgccacaataaagcccatgatcatccccatatgggtatgcagatggcgaaactgtgccagtatcagcgtaaattttgtatactcatagccctccggcttttccaaaagcctgccgtctttcagggagcagacatactcatccgttttttcccgtatctgaaaataataggtatcaatctcttctctttccagatgtttgtcagataccacatcaagattattcagattttccacatgtatggacggctccttaaaatctctgtctctcggatttataaaccacaaatcaagagaatgcagcatatggtaaatatgtttccaaaccggcatcccacaatattctttatcccaatattcatccgggacacagtcaatcacattcttcacttcccacaatgcccgttccgtctgatctgtgatgatatctgttaatttttcctgtttcaatattgctgcctcctttctttttatatccatacatactaaatatcaatggattttccgcatgacagatagccgaaatcagggagctggcaggccagaaattgatatgcttctgaacctgtacagtggcaagtataaaacaggatcccatcatatttccgcagctcctgtgctatattattcagtaaagaaaccggttccgtttttttcgtcaatggattaaataaatgaaaacctccgatacagacctgagggctgaatgctgctgctttctccatgatatttacgattccggtatgcccgcagcctgttataagcaccgttttcttttcccttataagcagattctgctcatggaggaaatcatcttttcccgacttattatataacgcatcattcgcaccggaataacacttatcccggcagctgacggtaaacaggctcagttcttcatcgatttgataatcaccttctgtcagtacaatctgcggattgcttttcagctccgtatcaagacctacattgactttcagaaaaaggaatttgctgtaatgcggttcaaaggccgtactctgcacatatatcctggcttttccattcacctgcaggaaacgtttcagcgcccctccgtgatccatatgtccatgagaaataacaaccgtatccacctcggataaatcaatattcataatttctgcatttttaaacagcgtatcgtccgggcctaaatcaaataatattttatgcttctgcgtttctatgtacagggataacccatgtttgggaattgtcctgccttcgcttttattttcaactaatgctgtgattttcattttggctccaatctaagtaagtttttattataaaagtggccttatttttgatagttaatttcaaggcaatatgataaaatatcactatgcagcccttcataacaaggcggccatacttaccttattacaatatggaaaggactcctgaatatgattttatcagataaaaccatcctgaaaatgcttgaaaacaaatccctgactattacccctgtggagaaagagcagatacagcctgcaagtgtggacgtccgtctgggcaacactttcagcatagtggaggatatgtcccgcggcatactttccctggacaacgaaatcgtatataaaacaataactgccgatacctatgtccttctccccggccaattcgttctcgcttctactatggaatattttgagttgcctgataatctgaccgctttcgttgaaggcagaagttctctgggcaggatcggattgtttatacaaaatgccggttgggtggatcccggcttccggggtgaaatcacactggaactgtttaacgccaatcgctgcgcaattgaacttaaggccggccgcagagtcggacagcttgtattcgcccagctggatgatactgcactgaatccctatgccggaaaatatcaggggcagcggggcgctaccggctccagggtatatatggatattgaggcgaaataattcatccgaagtttattgcacgggattgaagcattatcctttctttaatccagataaaatacaatacgatttttacttatattctcctgtataaatttgggtatcaaatccacccagcctaaaaccatacttttggtaaaaccggtatacctacagagtccagtcttggttttccaaagagataccgtttaaactacgttctttttcccaatgaacggcagcatccacaaggctttttccaatccccattcccgcctgctgcggtcagcctcaataccttcctttttacctgaaagaagttccacagtttcccattcggaatcattatagacagggacaagctgtccaataacatctacaggctggccggaacgaggcataaactgctttattgtttcatcagatttcataatagtatgcatagccgttatccgctgcaattattgctattgtccactgctcctggaattttattttatattgtaaaataacagattttttctctgcgaatttctataaatccgcactttcccgctactttttttgaagcataattatttttatcacagtcccatataggaatatgatttttctcaaaaatctgttccaatactttattagccaaggctgttgctaatcctttattccgatatttatccagagtattaatgccaatattgtctacatctccatagctaatacacacaatggcccatgagatgattctgtttccatccagcgctgcataaccaaaacccttctcaagaaatctttgtatattccagttactcataactatttcattcctaatatattcctcattctcataactacaggaaaaaaacaattcatctaaaggcacaaattggtacgtaacatcatactcaaaggactttgcatattctttacaggaaaaaatcaactgttcagatttttccattgatttatcagagaaaatttgggttaacatattaattaattcatccgaatccgctccaaattcaaagattgacatatttttttctttcataaagggaagaataacattgtcataaaatcccctgatttccctacacttatctgtagcaacaggatttcccataaactggaaaccttcctgatattcactgtatatcaacgctaatttaatattttcaacatcatctacccaaacccggcccggtgcatgaaacaacagtacagaaataaaatatatactgctgtttttatctattaattctctgacttcatctgtataactgtttagttctaccatagaccaaaaccttccctatatcttacttctgatatcttcaggaatacacattggattcctccgatttattaaccgagctctctattgtttattgcatctcttatatatgctttcgctatatccatagcttcgatcatattactaaagcgaacgtaatgggcggaaccgtcctcaaatttcagccgcgccttttcgcatttgctgataatggattcaattggggcaagcgcctgctgcaattcctctttcccgtacccatcacgcttttcctccccggatatcaacgcctttgcgatatataacgcttttattctgtttttaagaagggaatgctgcgaagttccttctgcaaatttaggccagaccttttcgcatctgcccacagcagattctatcacgcccaatgcctgttccttttccgtttcggtatatgtattcattccgtatccttctgtttctggccggatggagtactaggtttctttcttaatttcagtaccacaccctttctatccgcggcagcctgaaaataacctgccgcagcagccgctttttccttccctgtattttccggatttatttcggttttaatatgctccatcacttctctgatatcctgcagttccagcagattcaccgcaatgctgtagaaggtcttcctgcgtccgtcattataattatccagaagtactttcaaaatctctgccttttcttcctgctccgccttataagcctcttttcctatttgtctggcttttacactatcctgaatcatgttctggtgtgtgataaaagaatcgaattccgtcgcatgatcatacttttcacagggataactttcacacatatagcaaaactccacagaaccatgctccccagcgcatttaaagaacgagcagggctggtttccctctcctcctccgcatccgggacaataaccgcttagatgcatggtacacaagctgcagttcaatccgcagagagataaatagggatagaatctgccataatttttcattacttattctccttcaaatcaatcatcataatgtactcttcctcattttcatcaatgattgaaaaacctgtcttttgatacattctaactgcataattgtctttctgtacagccagagaagccttttcacagccttccctcctcaaaagctcaatcatttgttccatcagagccgtcccgattccatttcccctgaagccccggcggatggaaactgcaaattccggaatgctgtcatctacgctgccatatcccttaataattcttgtccagacagcgccgacaatcacatcgtccgccaccgcacacagacagtgatcatgcttcttttctccaaaattctcgatgtaaattctcagcgcaggctcctgaattatttccctgggcaaaaggtttttttcatctctctgaaatatagcttcatagagaaaatccgaaagcagctcatattccgacggatccatttttcttatttttatttccattttcttttttccactccataaggaactccttctccccggttccttcctctgtctgctcctgaaccatataaaagccttcccttttgtaaaaaccgactgcacgccggtttttctcatagacctgtaacgtcagcgtttcccgttccgctttcacataatcaagaagacgcctgccaatcccattgctcctgcatgacttaccgacaaaaattccggcaatataattccctgttaggcctatgaagccagctattttctttgcctcttcatagacatatatctcagcctgcggcagcatttcctctaccttactgtaattttccttccaataacggctgtctataaaatcatgggcctctatgttagactccagccacagttccatgacagcatgcagatccttttcatcaaattttctaatcatgaaatctaccgcgattccttttctacacgactttacatatttccattcccttattcctacggaagtatcatctcatcctccatccggacaaaaccaaatttttcatacagatatcttcccgccttcgtcgcttccagcgtaatatggctgacccctttttcctttgcttcctcagtcagcagctgcaggacatggtaggcgataccccttctccggtaatccggatgagtatacatgttcatgatataggctttttttcctgttgtattgtgaaaggtaggcatcacacgataaaagctgataccgcccgctccgacaaaaattcccctgtcaaaaacaagaaatgccgaatggctgccgtcttttaaggcagttaaataataatcatacgtttctttttctactgcggacatatctgcatcttcttccagttcatttgccgcccgcagcacctggatcctcgttttggtgagtatatcaatatcatcaaatgccgcttttctgtatgtcagattcatttattcttcctttgtactttcattcgaatttatatatgcatccagataatcatcattccacagcagtacttcaatatagcttcccgggtttccataaaaaccgggcagggagaatatatactcacccactcttttccctgacttttcaatcatatccaggaatgccgtcttattccacacagttccttccgtcattcccatatcctttaaatgcatgctgtcccttggtgtaaagctaatctcatcagcagcaatatcccttaacggaatgcgtatactgtccgccgttccgtaaaaggcctgaaagccgggatcctctcccaatacaaaatatatggggtgcctgtttttcggcttcccgtcgccctgacaaaatttttcatacagccactcttctgtcgccttccttttctggtaatagcgcgcaaaataatcaccgtaacggttattttttgaagtcgtcttttctgccaatttcctcgcaaacgaaaacgcttcttcttcaggcaagcgcataatattcattaacggcagaccgcccgcttctctgtaattggtgatataaagactgcctatatccagtttttccatggatttcaggcgtaaataatctgatcgcagaaggccgtagcacagcagatccgtaatacctttctttccacaccaggcccttctcagccttccttccccctgtaagccgcatcttaataaaaccttacccgctgtcgggttatttccctcacagcaggctgaaatacgttcagcctgcacctgttcgaataaataaggtaccaccgcacctgcagcttccttcatatatcccttattccaccattgcctgcccagacaaaagctcaatcgtgcacagtcggtgttcttctctatctcagcctgcaggaagcctatagcctgatccttttcttttaacgcaatcgcccagtgataaaaatcaggattctgatatgtctggcatacctgaagaatatagcggcctgtttcctccatacttttatgggaattccatggtaaatgggaggtcacttcctcttcccctgcccagttattatacatggcatatgtatcgtttaaagtaaaccggcgcagtaatagcctgtccgtctctatttcctgtgttcctatatctctcatatcatccctcctggaaatcctctgtcattatataagtaagttcgctattcccagggaaaatacctgaaaaaccgtatccgaaatattatagctcttttacaagataatgccgcttgccggtaaccggatattcctcccgtacaaatacctctttatatcccatctttttataaaactcaggagcctggaaactgaaggtatccaggaacacatatttacagcccctgtctgacgcagcctgttccgcccgcttaagcagttcgcttcccatattctgtccgcggagcgcttcatccacaacgagatattccacatccagccaattcccatgtgtcatgcctattaacccgccctgacagtttccttcctcatcttccagaaaaatccccagttcccttgggtttttatcttcaagatgagacaaattataagcaagaagcttgtcaaatacattcttgcgttcctctttagtaatttcctctgtttccctgtaaatcatagcattatcctccttatgcctaacctgcttgtttgttttcgttcagtccggataaatttcctttgcatcctccggcagccggcgtacatgctccaaataagctctgccgttttctgcctcggtattatcatagggataatccattgcctcagaaagctctgcagcaatttcatggaacaaatcacacatccctaaaacagaatcccatatggcttccgtttctgcggaggaatatgtagcaagatatctcctgtaaatatcttccgaaacataccgttccatatatttcgcacattttcccgcactgactgaaaaatggttatcaacacctattttccattctacaatccgggtgatcatagggcggacatatatattcaccatatccattacatagggtatttcttttcgccaaagaccttttgccacattgtttaggcaccaccagaactcattgcaggtatcatgaaattgttccggagtgggcttctttacccaatatatctcttctgtttttaccggttcggacggcagcagattatccttatccaccaaaacccgatataattccagatctcttttcaccgtttccattgtacatacatgcaaatccaaccggttcccatcggcaaactgcatcagccacccgtaacagttttccacgtcagaagggaaataggcactgtcctccggatactgcatgtacagacgcttcccgaaacggtcaatccaggagggatcctctcggaaggatttggtttcttccaccacatagacaacatcataatcctgaaaaatatccgcctgcacagtcggattgacacgtgatccctccaaatatgcggcgcggattcttggatcctcattcgctgtgtttataattaaatcaagcatttctttttctgaacgcatatcttaatcctccatcttaactttatattcacaccgcggttatccttccaaagcacactcatcaatcctgcgcaccacactcttggtataaggttcaaaatatttaggccagaacacatttgccgtaggattaaagctctcataatccactcccaggcggaggaagccttccttcttcagacaaagaatcatataatccagcagtccctgataaatattccttccccggtattccggcagacaataagcaccgcagatattccgcatatcctttgcctgtgtggcgaaattctccccactgtccgtcacctccacataggctgccaccttttcaccatccatggctgtaaaaattctggaaccgcttttttcttcctgaagctgctccgtatcctcctcctcttctcggacaggataccccataaaacaaggactcttgcccatgtgttccttcagcattctgtgaagtctgttcacctgctctttttccttcccgtcctcttcctgaaaggtaattccgaccggcggcgtgtaaattcccagcggttccatcatacgtatcgcatccgcacaacggcgaccgaaaccatagtcaaaaaaagcggaaagagccgtttcttcatgggcatacaaagctatggaatgataggcaattccctttttcacccacttttcagcagcagcctgatacatcctctgatacacttttcctctgttctcttttacagaaccatgcgcatgtatcggtgaaaaagttccttttgccagcgattggaatgcatgctcccatggctcgtgacagcataaaaatcccagcattttttctccttcgaatgctgccactcccagacagttatccgcaaaaggtgttaaatccggcagttctgttacctccggtaaggagggtacttttcttctctcgtcctcataaccggccattgcaagttcagcggcggcctccgcatgcttcctctcaaaatccactattatcataaattatctttcccctctttatcgtgtcactcttcttccggtaccctctccagcataaataccaccggacgtactccatccctacagcactctatggacttattttcatgcttgtaccaatattccttccccggctctctcggtactctgtcaatcgacatcctgcttatcccggcatataagtccacccaggcccacgggcaaaagcccgccggcatgacagcctcttccgaagatttgtaaagaaaagtatctccttcctttaaaatcggacatggccccactgcctttccttccgataaatattcctccgctatatcctcataaaactctgtttttattacttttatccgtacatccattccgttttcctcccatatctctattctacaagatacctgctatccccattacaatcccaatcacaaaaaacagcccgccgataccgataaaaataccacagaataattttttcatcccttcatcccgctccgcccaaatctgttccggcttttgggtattgtaatgaatttccacttcttccccttccttataacggcagggattgctgccaaaagatgaggctacccgccttacgcatccatttgcataatattcgaatatcggataataacagcctcctctgtcatttcctcttcgccattcaatacctgccaccctcgcggtggtgattgctgaagcattttcccttcttttgcgaaagaaaaccgccgcaatgaatccaatgactaaaaacaataagcctatcccgccaaaaattaccgaaataaaaatccttgcatccaacatataaatcccctctcatttccggcgcagtccgattacccgccctgtctttttcatctggaaattcccgcaacatggttaacctgtatccggtaattccgtttctgcatttcacggacaaatcctgccttatcctttaacgctatcaccatttcctgccttttccccttaatgaccagccggtccagagaagcggcactggaagcaatgggattatgggaaccatggatttcctctatgttttcaattgccatagaatccttgaaaagcccaaaatacagtaccagatttaattcatcaataaccacataattgcgtatgagcatcggcagataaataacattacagaatatcagcactcctaaaagaagcacgatactgtctccgctgaaaaacaattcataaagcagcagcgcattcgtcccaataacgataagccagtaccaccatgcaatttttcctttgaatactatgtttttttcggtttccaaatcctgcattcccatattactcctgttctgccatgaaacacgcgtcttttctttccagtataccaaaagtttatgggtaatactatgaacttttacataaaaaagaacaggtgagtgattcacctgctctgtccgtccttcttatttcccggtaccggataaccattcccctgggcatccgtagtgaggtcattcacctctctgctgttattctttctcagctcccggttcatagccccggcttcgtatgatcctttcggaatggtctgaagccttttatcatcctttgcttttttcatcagcacctccttatttcttttatgtctacagtattcccgtttttcaggaaataataaataaggtgctgccgtaatatttctacctgttttcctcaatcgcgtctatggcatcaatcactgttccgcggaaacctcttttttccagtgcgctcactccacggatcgtggttcctcccggagaacagaccatatccttcattgctcccggatgtgttcccttttccagataaagctttcctgtaccgactatcatctgtgctgccatacggtatgccgtctctctggagattccgtattttacgccggcgtctcccaaggcttccatgtacatggctgtcaaagcaggcgtgcagccgctgagtgtccctgcggaagaaaggtggacggaatccacaaattcgatcaaagatattttctgaaagagggagacaaaggcatccagttcttctccggaaagagaatgcctgttttcgcatacgaaaattccttcacataccgaaaccggggtattaggtattgtactgatatgatgagttcccggctccagaatttcctcatagcgttcaaaatcatatccggcagctactgaaatgaccgttttatccttgagtctgccctttatcggttcgaccaccgcttccaccatatacggctttaccgcaaggataacaaaatcgctgttttcgatcacttcttcagcagtacgcaaaggaacaatcccccttttttccgcattcctgcacagcttatcaaaatttccggcgcaggcacacatccggctccccgccgctgcctttgaagcgattaaacctgtggctatagcctgtgccatatttccatatccgataaaaccgattttcaattccttcatttcctgttaccatccttatctgccgctttttgtcttactcttccttcacctgtttactgcaataatttgtccagctctgcattcagcttttgcttcagttcctgcagttcctcatcggacggcaggtactgctctgcgtacatttcctccctcggcagcttccagaccgggcccggcaccggagtatctccctttcttctgggaaaaatatgccagtgcatgtgcacattttctccctggcccaataactcataattcaatttatccgggccgaaagcattatataccgcttccgccaccaaagacatttcattcaggaacgtttccctgaaaggcctctcaagaaaatggatttccgtggcatgtactttacaaagaaataaggtatatcccttaattctctgatagtccccgattaccacataaccggtttccagctctctgacaaaatatctgtttttaccctctatggtttcctggattgtttgacacactccacacataagctttctcctccgtctcactttatctcatatttggcaaatgctttctccgcatccatatgaacctctctgaaaaataatacaagccagacaatgtaagccccgacagcgaaataacccgaaaggaaccaggaaccaagggcgccgatcagcataataacagaccaaagcgcaaaatgattcctatagtcctttgccatccttttcctgtcatatttttcctgcttccatttcggaagggtattaaacccgctgatcagttttgccgatttctccttaaaaacggcaaaaaccagcgccagtactgcaaaacacggaactaaaataatacacatataaaaaccgataagcatttaaaccctcctgtatggaatgtcaccttttgaaattaacaattttggccttttcatatatctcaaacatattttcaaaataggaaggatcctgcgtttcctgctccccattttcggaatcaaagtatgtatatgaagcatttccgtccgtatcgaaattttcatttacatattggacagctaccagctgtttctgcgaatcatcgactgcatattgtgctgcgaagtggccgccggcagcatagatccagttttcatcatatctgacaggataagccgttcccagtgattctaccgtcccgatttccttcacttccccgtcccacgcataatagactctgcaggttattgccgcctcagtatcttcatcgtagctgtaggtcccttccgcaatcagcaaaacaggcaggccgccctccgggcgctccacaaatgcataggcctcatcctccgacatcgcttctattacagaagaataaaccttttccggtttttcctttccgcatccgattaagccaagcatgctgattaacaaaataattataatcccttctttatatcctcgtctcataattctcttcctttcatttccaagtttttcatccgtctttttcttaccggaatattatttccttattaccgcacaaatcgtctcgtccctgcctgtaaaagctttacctgccgcatcatcgtaaaattccggtgctgcaaatccggcattcctgatttccgcctccagcatttccctggaatacacctgattccagatattatagcattcacaatcctcttccgtaaccaccacatattgctccagcgtattctgcgaatcatgataaacagaatttctctgaataaccgcatagggcttttccgaccagaaaccgctctcttcatatcctacggaatccttttcctcaaaagtgctgaggaacttatccgtccatccgtccaggaacagaacgcctccatccttcagggcctttctgcacttcttcagcaatacagccctgtcctccggcgccagcacgccaaaatcacaatagattaaaatgataacgtcaaacttctcctgataatcaatttccagataattctgatattgataccggatattcatatgtttctccgccgcgtgctgcttcgcatattgtatggaacgcgcggaaaaatcaatgcctgtcacacagaagcctctttctgcaagaagctctgcataaatacccggtccgcagcccagatcaagcagtgtttttcctgtccctccaccgcaataaccgcaaatccagtcaactgatttcctgacgaactccattttccttgtcgcaccgtcctcctcctgattgagatgtgcttccagcatatactttgaaatattttcatcatcccaaaaagcagacgagcttttttcatataccttaggtttttctttcatataacgtaaaaaatcatgattaacctcgctcattaactaacttccttctttctttttccttccggaattccgaaagccttatcccctcttttcctgactgcaggccagatgctttgccagaaaaagacagggatttgcttcatcccagagcaaagggaaaacctccagagggataaatcccattttttcataaaaccgtctggtccgttcatacggttcaaaatccacagaaccatccagtgtttttaccgtaagataaaccaatcccttctgttgacagtactcttccgcacgttccataagctccgatccaatgcccattctatggtattctttcagaatgcccatgacacatacctcggctgtgaaggcattgtgtaccttaaccgccagaaaaccaaccggcctttctccgtcgtataccccgtaaaacggcatctcttccaccaggctgacatattccgctatggattcttcaatgccaaaccattccggcagcctgtggagaacagtatcacagatttccttttttgcatttccgtctcctacttctcttatctccatcactattctcctctccacggtaaacaggcaggatattgtttgctccattataccctctaaaggaatgaggtacaatggctttcttttttcctgctgaaaaaacatagccgtaccagcttgccccgctgatacggctatgtttaccagaaagctttatttactgctcattcgtccctgccgattgtatggttttgtccatagattctctttttaacggcatttattttatagataatattacttgtatatatcactgcggtaatcagcattccgaaggacaccccttcgcaaaaatctgcaatatttccggtaatacctttatccgcaaggcccgttccctccaaaattaaaaaagcaacaaagctgattactccaatccaggcaaaaatatggagtttcttcatcatacgcatcttttcatcattgctgtaatcggccgcctttaatacagtttctttcatatccttatccattttcccgctttccctttctccattcaataattctttcaattccacattgtaatactctgatatcattactaagatatccagatccggcatgttgctgccggtttcccatctcgaaacagttctgcccgaaacattcattatttctgaaaactgttcctgtgtgagtcctttctcttttcgaagctcctttagaaagcttccaatcttctgctgattcaccaggcatacctcctttcaaaagcaatcgtaaaacagaactggtgaaaaaaacacgacataaagcgggaaatggcgtattttttataaccagacacaaaatgtccggagccagccgccaaagccaaccccggacaccattttttttatctcactatctgttattccgtctccatgatttgccaaaccctcttctaggcttcattcatccttgcgagttttgcactttggtcggctgctataaggctgtcaaggagttcatcgatatcaccgttcataatatcatcaatcttgtaaagcgtaagtttaatccggtgatccgttacacgtccctgagggaaattataggtacggattttttccgaacgatctccggttccgatctggcttcttctcagctccgcctcagcatcgtgggccttctgctgttcgatgtcatacagcttcgcacgcagcagggcaaaagccttggccttattctgaagctgggacttttccgtctggctgtataccacaattcctgttggataatgggtcagacgcaccgcggagtccgtagtattaacgcactgtccgccgtttccggaagcacgcataacatcgattcggatgtccttatcatcaataaccacatccacgtcctccacttccggcatgaccgccacggtgatggtggatgtatggatacggccgccggattccgtttccggcacacgctgtacacggtgaaccccgctttcgtatttcaggcgggaataggctccttttccgttgatcatgaagctgacttccttcatgccgccgatgccgatttcatccgctcccaccagctccaccttccaacggtttcgttccgcatatttcacatacaaacggtacatttccgctgcaaaaagcgccgcttcatctccgcccgcacccgcacggatttccacaacaacgttcttatcatcattaggatccttgggaagcagcaggatcttcatttcctgttccagctcctgaatacgccttttggcttcactgttctcttctttcagaagctcccgcatttcctcatcggactcggattccagcatgatcatactgtcctccgcgtcctgttttacttttttatattccttataggcctccacaagcggtgtcagatcgctctgttccttcatgagggaacggaaacgatcctgattggccgttacagaaggctcatttaattcattcattatttcttcataacgacgaagcaggtcttccagcctgtcaaacatattttatcattccttccttaacaggactgcctgaatcacagcccatttcctttactcataccacaatccggataccactcggtcaagtcctgcaaaatcctttgtcaccctgacctcagaaaatccgtgcttttccatcagttctttcacagcctcaccctgatcataaccgatttcaaaatacaggctgcctccccgaacaagatgctccgggcagccctccagtattttccggtaaaaaaccaggccgtcctcccctccgtccagagcggaaagcggttcgtgaagccttacctcatccatcaggccgtcaatgacccgggtttgtatataaggcggattggatactataatatcatatttatcttctatcttttcaaacagatcactgcgcagaaaacagacctgtattcccagcctgcgcgcattttctccggcaacagccagcgcttcctgcgaaatgtcggctcctgtcccccggcagtcattggaataatgaaggaggctgagcaatatacagcctgaaccggtgcacatgtccaggattctgctcccatccatcatttcgcgcatcacttcttccacaaggatttccgtatcctgcctgggaataagcacgtgttcgtttaccagaaaggtaagccccataaactcctgctcaccggtaagatgctgcaaagggatatgctgcgcacgtttctgaatccagtcctggtatctgtttttttcctcttcggacagcagcctgtcgccatgtacaagcagggtatttctgtctgtcccgcatatcttttccaaaagcagccttgcgtccagctccgcttccgatactccggccgtctccagactctgctttccccagtcataaccttctttgtaattcattgcagtataggctcccctgcctccgcttctgccacaccgtcctcttccaaagccgtttctgtccggccgccgtcatccatccaggattcatccacttcataaccgaattcttccttcagatatgctttccagtcaaacacagcttctacggaagcgatagccacttcaatcatgctttcatccggttccctggttgtcagcttctgaagccacataccgggcttggaaattaagttgatgaagatattgtcacttctgcccgcaagacggataatctcataggaaattccagcaataaccggaatcagcagaattcttaccaccagcctgagtcccgggttttccacccgtataaacatgaaaaggataatactgattaacataacaaacaaaagaaagcttgttccgcatcttttatgcaggcgggagcttctcatggcatccttaacagtcaggggacggcctttttccaggcagttaatacacttatgctccgcaccatgatattggtaaacacgcctgatatccttcattccggcgataagggccacatatgacagaaaaatagcaagacggacaatgccttccaatatagcaagaagggaagcgtttctgatgtaggaatggaacagaagactgattccatagggtagcgcaatgaaaatagccactgcaagcacaatggaaaaggctacggttaaacccatcaaaagcttttccccattccctttgctcaccttatccagcacctgatccgttttggtttccttggcatcctcttcctcataaaagcttgctgaataggtcaatgtctgcattcccagaacaagagaatctataaagttaaaaacccctctgataaaaggcagctttgtcagcttgctgcccgacagaatcccggtatatttttctttttttgtttcgatgtttccgtccggctttctcaccgatacggcatactcgtctttgtttttcatcatgacgccttccagtacggcctggccgccgattccggaatagtgtccgcagttctttttactcatatttggccctcctgtccgccctttatccgcagacgtcaattcaaaggctgaaagcttcccttcaccctttttcctccctgacgggttccacagtatgaaaaagaaggttgagattaattaacctcaacctttcttgcagctcttatttgttttccacaccatacttcttgttgaacttatcaatacgtccacgagcctgagcagccttctgctggcctgtgtagaatgaatggcacttggaacatacttccacgtgaatctcgggtttggtggaaccggttacgaatgtgtttccgcagttgcaggttacagttgcctggtaaaacgcaggatggagtccttctttcatagttttcacctcttctatattttttgttcccattaatatttcgttctcatccacttgcctttcggccgccgctcacagttctgactgtaaacagctttttaattgtagcatagcttttccatcaatgcaagtagaaaatccgcttattttccaatattttgcggctttttatgaagaatcagataaatttcatttttttaaccagatttacgaaatccgaattgtttttggtgcgcgcaaacatatccagtatcttatccaccgcgtcctcaggtctcaggctgttaagagccttacgcaggacaccgatagcctccagttcttccggggtaagaagaagatcttcccttctggttccggatttggggatatcgatagcggggaatacccttctttcggaaagctttctgtccagcacgatttccatattgccggttcccttgaactcttcatatataacatcgtccatcttgcttcccgtatccacaagagccgtagcaagaatagtcagactgccgccttccctcatatttcttgccgcaccgaaaaagcgcttgggcatatgcagggccgccggatccagaccacctgacagggttcttccgctgggcgggattaccaggttgtaggctctggtcagacgagtgatactgtcaaggagtattatgacatccttcttatgctccaccagacgttttgccctctcaataaccatttcggacactctcttatgatgctccggcagttcgtcaaatgtggagtaaataacttctacattggggccttcaatagcttccctgaagtccgttacttcttccggacgttcatcaatcagaagaataatcagatgcatgtccggattattcaccttgactgactgcgccacctgcttcagcagagtcgtcttacctgccttgggaggggaaacaatcatacccctctgtcccttccccacaggactcatcaaatccataatacgcattgccacggaagagcgtgacatctcaagacgcactctttcttccgggaatataggcgtcatatcttcaaaattagttctcttcgccgccacatcgggagcataaccgttaatggattttacatacagaagggcagagaatttctcattctgcgtcttaattctggtattgccgactacaatatcccctgttttcaaattaaatctgcggatctggctgggagccacatagacgtcgttttcacccggcaggtaattggcgcagcggataaaaccatatccgtcaggcataacctccagaatcccgttagcggtaaccccgctgtccagatcggaagggaacttctcatcttctgcaatggcaggcgccggaatttccgcttgggcgatttcggctctttccacaggtgtattcctgttttcattcctgactgtattatccgtacgttccgcgtaagagggccgttctcctgtctgatttcctgaagtattctgccggtttccattatttacaataatgcttctctggctccgctgctcctggcctccattcggacggctgtctccgtttttacggattccggtgtctctgcgtaccggtctccgatccgtattgcggttctgggaagccgtatgagactcctctgcagctgcaggctgagaaggggccggtgcctttacaggagccggcttttcttccgaagctgcgctctttacaggctccgttttcttctcttccgctgccttttccctgcttttttttgtctcatgagcagtcctgggtttttccgctgtctcttcctttgtctctgctttgggcgcggctgtctgttctttttcttccttttcgtccagcgctaccatagcatctatgatatctgcctttttcattcctgaagttcctttaattccgcgtgattttgcaatttccttcagatctgctaatgccagagactgatacttttctctcatacccatacctttcctccgtaccaaacgtacaaaatgttactaaaatacatacaacaaatccgccacaataccatccttaataataaaaaaggtaggtttcctgctgcttttttctgtcggttattcatttcaatttatcagggaaataattaatgacaacaggcctttctgccgttattcaggcgcgaaagccagctttccatgtctgtctactggcaacgccgtccaatcggaacagtaacgccaacaagatatgtattggatataatactacaaaattggtatctttatgtgaccacattatacaacactataccaaaaataggaagcctttttttcaaaaagcttcctgttcatgggaaatttacgttgtgatatactatctgttaataattattaaatcctattacctgacatttttaatctgtaatctcatttccattcaattagaaatacctgttaatttaagcatatccttttggctgttcctgtattaaccatagatcagaggtattacaatccgtatccttactgacataaatgtttccttcaggtgtattagttataaatttacattcttttcctgtatataaaaaatctgacgtttcatgctgccaacaatcgagtctttctctcatatccaccagaacactctcatattcaggattattaacctggtttttggcttcctgcggatcaaacattaagtcatacagctgttctttatccacacttctgtcctgccagccattctccatccacatctgtttggacaaaccttcatcacaatctgcacaataaaccttgttccgtgatgtatatctcctaatatataaataattaggtgtacgaaccatacgctgtggttcataattgcaatgataggttatttctgcaaacagttcgtcccttatctgttcgttatttccttttaataatggaataaagcttgtgccctgcagccatggcggctgcggcaattcaagtaattcacaaatagtcgggaataaatctatctgagacaataaagcatccgaagcactgcccttcatgatttttcccggaagtgacataatacaaaatacgcctgttccaaatttgttgagattacatttcatagctggaaaagcaattccatgatcggtcgtacacaaaatcaatgtattttgaagcagtcctctggaatccaatccattgattatgcttcccaccgcattatcaaaaattttagcttccgccatgaatcctgccgtatcttctcttacctgccttgtatccggcaaaggctccggcggataaatataagctggattatattgagcagtcccatctctatatggtctgtgagtatctccaaacccaatatccaagaaaaaggatcctccatttaaactatccaaagcctccattccctgacatactaatttctgtgagtttaatacctttccacctttcttttcttctaagataatgtcatacggtataccatccctatcctttacaacatgctgcgtacctgccagtattgttttataaccattacaggataaccatggcgcaagatggcattccttcttttccaattcaaatcctctgtttaccagcccatacatacccgaacaatgagcatacatccctgtaagcattgctgcgcggctgggcgagcagcttggagcagcacagtgcatattacgaaacagcatcccagattccgctaactgctgcagacatggcgtgtccattttatatccaaaaggactgatatatctgccgacatcatggctatgtatatataccaaattaatcctttccatattttatctccttctttccataaatttctctatactttccaggtgtcataccaacaattttcttgaatgaacgaatgaagctggatatactgctgtatcccagatttcctgttaaatcttccagactgatatctgttttacacaacatttccttagctttattcatctttttttcatttacaaattctattaatgtaagatgcatatgttttttaaaataatggcttaaccatgaaggggaaacagaaaaatcatctgccattcccataatagaaaaattagttttcataaaattttgatttatatagtctactacaaattccattttcaatgcgttttcatcttcttgtgatttattcataaccagattcaccacatcctggcacagagcagagaaaatacgacgaaaccgattccaatcaatgactccatcatattgctgcagtaaaattcccaaatctttattaataacctcagccaaatctccattttcatgaattgaaatactttccattaattgaaaaagtgtctccttcaaacggtggcggggcagcgcttcatatctgtcattttccaaatcagctggcattcttaatacagattctatgtctcccactattattgatgtttccaccttagaacaaagctcatccagaatatccggtctttgctgccgattctccattaccttttcataagaaataaccctttcctgttttgcacccgaaaaaaaatcccatgtaagacaggcttcaaaataagcattggatattgaatttacgctgctctttaaacttgaagtataaaaacgtatctctctatttccttgtcgttctaataactccgctatttttcctaatttctcaataaatctctctgatacagaagaatcaaaacataatatcaacgtatctctttccataaagggttttcctaatacttcaatacctttcagccaatcattcccctgcctctttatacaatcatactgtcctggtccaatttcacccggacagggatccatacatactaccagataattcataccaaattcttccctttgcaaaaaagaaggtaagtattcttttttatattccaaacctttcaagagtcggaacacagcataatctctctgcagcggctccagttccttcatctgtctgtttaccatgtcaagtccatctgaaagaaacctgactgcctgctggattgtttctatttcattcaactttccattgccaaattccttctgcatgcctttctttacatgttcttcaagccgtcttataggcacataattagtatataaaaaaagataaataataatactacctccaagaaggagtcctgccaaaatcccaaagtaaacctttttctggtataccaagtctcctgagactgcagaatatctgaccatactataatatttccagcccgtttcagcacccaggcaataggataacaaatatttttcttcgcccgaattaaaaatatctgtaccttcaatttgacgacttccataatgaatcatctgctctggagtacacaatgcttctccttcctcccagatcagctttccctggctgtcaagaatcacaaaatagccttcttgaaaagaatcagaagctctgataatacggctgacttcagccatactaataaaagtcataatcactggtttatccttaccattatcatgcattggataccactgtaccaggtattcctgcttcacattaccaggaaggcttacgaatgaacgaaaaaactttaaatcctctgtactccttaaccttctctttaattcttcactgtcccattcttcaaattgtaccattttcccacccagataacgtgccgggaaagtccctctatcactcaacagcaaagtatcctccccccgataaattactatagaggtaagaagcttattaaagagaagaaattctttcagctgggaaactgcctgacaataattatagggtgattcctcaagaatataatttttcatcctgttatccagcctgatattctgtacaatgtcatctgcattttttattgcaggatctatacttccttttacctgttccacataacctttttgcatagacattatatttttttgcattaatttaccggaatgattataagaaaataaaaataaggtgcttaagggcatgaccagaacaagaatataggaaataagatattttacaaaaaactcatattttttcaattttcccttttctctcgcccccatacccctatcacctttcttctttacatataatttttactccatgtaattattataagcatcaataaatatgtccatcgcttctgataaccccaatttattcaactgatttagatattcctcccattgttcatctatattgccctcactgataaactttgcacgcatcatttcttcataactgttaatatccggcataatttttttcaatgtgttcatctgctccagagagaacatcacattaggataattttctttttgaagataaggctctactgctttctgaaaaacatctctgtccatttgctgtttggcaggagtcaatatgtcttcaaattctggaaaacaagcataaggcgcagaatctgccgggcagtttccccatctccacattccataagtcaactcttcaggcggttcatgcgcgataacagtaccatcctcatttttctctgtcattacatcgtaaggtccataaaaggtctgaattgacatatcctgagaataccattcatctatccaccgcatagtagcttccggatatttatttgaggaggtaatttcaaacatattgcggccaatacgcatatcgtttactactgtccatccctgatcgccatttggccctttcagcggcggaagctgtacaaaatccttctctgctctttcaaaacctacagaattggatattgtccatgctgtaaaggaaccgattaattcctctgtatcctggcatttagcattataagcttctccggaagtagtgaatatctcaggatccataagcccttccttataaaggcgatggagatattccaaagccgccttatacccttcctgtgcaggtgtaaagagtggctgtccatccttcaccatcaaatgataaatggtatctgagtaggaagtattatcataaacgccaaaggccgggaaaaaattagcctcagagttggttgcatttcccatctgatgatacagtatcagtggaatttcatccgctttgccatttccattaggatcttcttctttgaattttttaagaacctcataatattcttccgttgtagttggaatttctaatccaagagtatccaaccatattttatttattgccatagtatccatagtattgggaaaataggatcctctgtaccggaaaagagagtaaatctgcccatctgcagatgttaccaccttttttaattcctgttctttttcaaagcattctttgatattaggtgcataattatcgatcaaatcattcataggtataaaggactgcacattagtaaggatgtccatatcactgattccttctcccagaaaggcatcaggtaaatcaccgctaacaaacatcaggtttttcttttcattccacgctgtaggtccaatttcaatccactcaatattaatgtttgtttttttcgccaaatcatttagataatcaatttctgccaaagatttcctatctgaatcaactgtacggttaaccgcaatccgcaatgtaataggttggtttacaataggataaccagtaggattaaaattgctgctgtcttccgcattttccatactgcttacttcttcctgtcctgtactttctattccctcaagagtcggtctggaacatcccccaagcaagctggcaagcataacaactgacaaaaataaagctgaaatttttttcatatactcttctcctattattcattatattgtttttctctctgccaggcaatactacttctttatagtaagtatttcccatttcgttctgttttccatttattcatcctttaaccgatccaatcatcacccccttaacaaaaaacttctgcagaaatggataaacagccagcaccggcgcagatgcaactattatcattgcatacttcaccaaatctgctttatgccgcatggaattaaccaaatccggatccatgctcatcatttcctgctgcagcaaaatctcccttaagaaaagctgtaaaggaaatttgtttttgtcattcagatataccagcgcattaaagaatccattccattgattcacaccataaaagagagctataaccgcgataataacccccgaaagaggaagggcaatatgtataaagaaaagaaaatgcccgcaaccatcaagctgcgcagattcaaacaattccagtggaatattttcctcaaaaaaggttcttgtaactaccagattccagacgcctacgcatcctggtactattactccccaaatagtattgacaagacgcagctgctgcatcaataggtatgtcggtaccaatcctccgctgaatatcatcgtaaaaataataatggcattaattactctttttcctgtgaaatgcctgacggaaagtgcatatccgcttgtcagcgttaataccagactaagaagtgttccgacgattgtatacaggattgtattatagtatccaacataaatacgggcatcttcaagaatcgttctgtacccttcccacgtaacttctttgggaaacaaatatacttttcccgcataagtcagatcaggattgcttatagatgcaatgattacaaagtaaagcggatacaatactattaaaagtaaaattcccgaaataattcctgtaataacattaaaagcgtgatcttttgtcttcccttttattctcattttcttttctcctataacaggctcacattgccggctcgttttgcaataccgtttacagacaaaataagtattaaattaataatagaattaaacaatcctattgctgctgaataactgtactccattcctataagaccagttttatatacataagttgaaataatttcagaagctgaaatattcatgggattttgcattagtaatactttttcaaaacccacactcataattctgcctgaattcatgatcagcaataccacagcagtgggaagaatagatggaatatcaatatacagaattttttgcagctttcctgctccatcgatttctgcagcctcatataaatccggactgacagaggtaagagtcgctatgtaaattatggcatcccatcctgcatgctgccatatttcacttataacaaatataggacagaaccacttttcacttcccatgggaatacctgcttttccatttgttacccagttaagcaggttataaagcaatccaccaggagaaagcatgataacaatcattcccaccaccgcaggaatagaaataaaatgaggagcatatgttgctgtctgcaatactttttttaatttggtaaaattaagttgatttatcataagagccagtaaaattggaacaggaaacccaaataccagattgctcagactgatttttagagtatttgtaataactgttttaaattgataagaatcaaaaaatcttttaaactgttccattcccacccatgggctcttaaaaattcccatataaggagtaaattccttaaaagctatctgaattccagccataggaatataacagaaaataaaaaaatataataatgtaggtaataggaacatataaatctgccagtccctcttcaatctttttcctatcgcaactccttttccttttttatatacatttctgactttcactgccattctccctccttttctgtttttatcatcgtacacagccttatttccttttgtaaatattcacattatttgctaatatacataatttttgtacatacaaaaaacttctcttatgcaaaaaaagcagtacaggaaactgttttcctgtactgctttcacctatttcctaccctgttccaagtaggatatcatttattgtattttattttaatgagaacaccatcctcaccggatcatggtccgaaaactggtaaccggtatggatgttttcatattccttcattataatattatccgatataataaacccatccagcgtcaccgtataagtaaccccttcctcataaggcatatccgcattgcgggcgctgtccggcatggaggctctttcctcttccccaagcagatcaatgctgaacgagaaaccttccggcagtttttctctggggaaaggatacgcccaggattccctatcctccgaaacatcacccaaagccttcaaatcgtgattgaaatctcctccgcaaatcacataattccccttttcatactctgcctgcatgtctccgcacagcttgctgatctgcgcctcccggatagcatcactgtttccgtatgcggacatatgctgggcgaaaatcaccagctcctttccgttttccaccggtatccggctgatggaatagcatctgtccagatccaggaacttactgaaggaagtagaaataggaaagcttttcctcacaccggaggtaacaggatatttcgaataaagagcgattcctgccagactcttcccatgaggctcccaaggcggcaccatcagaaacgccgaatcatagttaacggcaaagtccgaataatagctgccgaaaaagccgtccagcaattcatactgatccacatgatagctccttgtagaatccaaatccacttcctcgaaaatcataaaatccggatcatatcctgccgccagccctcccgctccggaaaccgtttccagcacgctctccctgctcttcgccacagaggacttcccgccatccatgaaaaagctgtagtcgggcgtataagcgccgaagcctatattataagtcatgatttcataatccgtcccggaagaaacctccgcccccgcttctccgccttctgtcggctgccgtatctccaatgccagatcatcaggcagtctgtggtaactgatcatcacatacagcacataccctatgactgccaggagcaggacagccactatccccagcaccacccgcagccatatccgtttcttttttttactcttcgccatattcgtttcctcccgcaatatgtctttacctttataatactctaaccggtaaaaaaacacaatctcgcataatgtctgtgcttttatcctgtttaccagcaagtttcgctattgcggatcgaatccaaatattatatgatatttctatggctgtcctgaatatcacagaatccagccacaaaaaaaggcggaggaataaatttatgaatacaaacgaaaaagcactggaattacataaagagtggaacggcaaattagaaaccgtttccaaaacacctgtaaaatcaagggaagacctttcacttgcctatactccgggcgtggcagagccctgcaaggtcattgccggggataaagaagctgcttatacctataccataaaggccaataccattgccgtggtttccgacggttccgcggttctcggcctgggaaatatcggcccctatgcggccatgcctgtcatggaagggaaagcggtccttttcaaggaattcggaggggtaaacgcggtacccatctgcctggatacccaggatacggaagaaatcatcaaggcggtcacctggatggctcccggcttcggcggcatcaacctggaggatatcagcgctccccgctgctttgaaattgaagagcgcctgaaggaaactctggatatccctgttttccatgacgatcagcatggaacggccatcgtagtccttgccggggttatcaatgccctgaaggtaaccggcaagaaaaaggaagactgccgtgtcgttgtgaacggcgcgggaagcgctggagtagctatcaccaaactgcttctgaattatggttttcctcatattattatgtgcgacaaatccggcattctttccaagaacagttctgatctgaactggatgcaggaaaaaatgatggaggtaaccaatgtggaaggaaaaaccggctcccttgccgatgccatgaagggcgccgatatctttgtaggagtatccgctcccggaattgtatctgcggaaatggtttcttccatgaataaggacgccattctttttgccatggccaatccggtacctgaaatcatgcccgacattgccaaagctgccggagcaaaagtagtaggtaccggccgcagtgatttccccaatcaggtgaataacgttgtcgctttccctggtatcttcaaaggagcgctggaaggccgtgcaacccagattacggaagaaatgaagctggcagctgccctggctatcgcttcactggtgccggacgaagaattgaatgaagacaacatcatgccggaggccttcaatcccaaggttgcggaagtggtggctcaggccgtaaaatcccatattgcccgctgagcctatggattatcatggcaagccctattattcccttgatgcctggtgtaaaaatacctatggggaaaaattatataaaattgcattagacgcgggccttacctgccccaacagagatggtactctggacagcagaggctgtatcttctgcagcgcgggcggaagcggggaatttgccgcagggagactgcccggagctgagccggtgtatggcccgttttccatccaggaacagctggaagccggaaaaaagcttttggaaaagaaaaaaacaggccgccgctatatcgcgtattttcaggcctatactaatacctacggccctgtggattatctggcctccatttaccgccaggctcttatggaaccggatattgccggtatttccattgctaccaggcccgattgtctcggaacagagattatgcgtttgtttgcttccctgaagcaggattttccggataaattcatatggatagaactgggacttcagacgatccacgaagaaacggctctgtttatccgcagaggatatcccctttcctgttttaccgaagcgatggaagctcttcataaagcggatattcctgtaatcgtccatgtcattctgggacttcccggggaaacggaggaaatgcttctgcagaccatccgttttctgaatcgctgcggaatattcggaatcaagctgcagcttcttcatattctggaaaatacagatcttgccgtcctttaccgggcgggaaaagtccctgtactctccatggacgcctatctgtcttgcttacaaaagtgcattgccgccctttctcccgatattgtcattcaccgggtaacaggcgacggaccgaaaaatatattgatcgctccgtcctggagcagcaataaacgtaacgtgttgaacacgcttcatcagcgcatgaagctttcctctatcagacaaggacaatgctatgaatcaggaacctttgactctctacaaattgattgtgctttatatgttggacagggtcacttttcccctgaccacagcccagatcagtgaatttatcctggaaaaggagtataccaattttctcactctccagacggccatttccgaattgacggaaacaggcctggcagaatcccggacccttctcaaccgtacccagctccagattacggaggaaggccggaataccctgcatttttttgaaaacaggatcagcgatgccattaaaagggacattatcgactatttcaaaaaccataagctggaactgcgcaatgagtcctctattcagagcaatttttacaaactggtaaacggcgaattcgaggcacagctcgtggcaaaggataaggacgtggatcttgtaaatatacggatttccgttcccacccaggaactggccgcttccatctgtgataactggcagaaaaaaaacaaggaaatataccagtatctgactgagcagcttttctgaattattataaaaaaacagcccccggccggtaagcttcactgtaatgtgaattcttacggccgcggggctgtttttatttattcccgcgcgccagtttggcggctgacgcagggctttgatttttttctcaatcctttgcaacaggatattcgttgcacagaagtctgtaaggaggttcatcctcttcgatttcagggaaacggccgataggctcgtagaaacggttatccgtattatcatcattgcacatggacacttcacccagcagtacagggccggttccgggttccagttcaaaatcatgatacatataaggatagatagtaatggattcgccgggtttcagcttcacctgtgttcctgccggaactgtgaattcccgtccgtcacagttaacggtaacatccgtatccgcgaactgttcgtcctttgtggaattgtatacacgaatcagtacatttccgccgcctctgttgatgatgtcttccatcttgttccagtggaaatgcatgggcgccatctgtccttcctttatgtacagaagcttttccgcataggttttggtatatttgggattcttcaggttgccgttacggatggtaatcagcgaaaaaccaacctcgtcgaatttgcccaggccgtaatctgtaatatcccagccaagcatgttgtcccggatttcatcatattcatggctcttattctgccattcctccggagtgaaatcgcagaagggcggcaactcgaaacgatgctcttttaccatggcttccatttctttcagtgccgcattgatttctgatctcttcataattttcagtacccccatttctggttttccaagttttttcttggtatcagtggtattataccttgtcctgcgtcttcatacaagtatactttttttacttttacgtaaaaatacgttagatttttttccacatccggatgcagattacgaaacgtactgctgataagctctcagcctctcttcggcacgtcatttccgttatccttttcttcctcctgaccggctgcctcctgcctgatgcgcttcatatgttccctgattttcacctcatagccattcccggaaggcctgtaaaattcccttccgctcaattcatacggcagatactgctgcctcacataattattcggataattatgggcatatttataatccagtccgtgtcccaattttgccgctcctttataatgtgcatcctgcagatgagagggaatcggcaggtttccggtttcctgtacacagcgcatggcctcatcaatcgcgcataccgaagaattgcttttaggggcacaggccacatatgtcaccgcattggccagaatgatctgggcctccggcatacccacccgttccacggcaagggatgccgtaaccgccacctgaagcgcctggggatccgcgtttcccacatcctccgaggcacagatcataatccttcttgcgataaaagtaacactctctcccgcataaagcattttagcgagataataaacagccgcatccggatccgaacctctcatgctcttgataaatgcggaaatcgtatcgtaatggttgtctcctgttttatcgtattttaccacacgtttctgaatgcattctcccgccacatccagcgttatatgtatcttcccgtcctctccgcggggcgtcgtcataattcccagctccacagcattgagggcgtgcctggcatcccctcctgccaaatccgccagaaaatccatggcatcctcttctatcacggcattataagcgcccattcctttttgctcatcatacacagccctgcggatgagttcctttacatcctcccgggacaagggcttcagttcaaaaataatggagcgggatatcagcgcgccgtttacctcaaaatagggattttccgtggttgcgccgataaggacgatagtgccgtcctccacgaaaggcagaagataatcctgctggcctttattgaacctgtgaatctcatcaataaacagaatcgtttttttcccatacatcccctgggtgtttttggccttcgccaccacttcctccatgtcctttttcccggaaactgtggcattgatctgggtaaactccgcactcgtcgtattggcaataacctttgccagtgtcgtttttcccgttcccggcggcccgtaaaaaatgatggagctgatcttatccgcctggatcgcccggtaaagcagcttgtccttgccgataatatgctgctgccctaccacctcgtccaaagtcgtgggacgaagcctggccgccagcggggcttccttttccatgttgttttctctcatataatcaaataaatccattatttcttctcccgcagccgcattcctttttccttttacggcttcctttattataacgaacccctatagacaagtcaaacattctgcggttctccattgcctgaattcactccgcatattttaacgccacatccatatactaaagggcaaaaggaggagcaacagcatgaaagatgaagattacaatattcctgaggatcaggattataccagcgccgtgtcagcctatgactgtaccggtctgatccctgccggtaccgtacatgaaaaagagctggaggcttataaggagctttatcccttcggcgcacctgacatgagcagccaggagatcgcacaaatgagagaaaagaacaaaaaggatgcttccgatacagcgaagcagtaaaagggaaaaagcccggaaagcacacagccttccgggccttacaggtttttcagtcaaacaggatttcatccactgtcacgaattcatacccttccgcctggaggatatccacaatctgcagagcggccgtcactgtggaatcataggaatcatgcatgaggataatgctgttttcctttgtatgggacagtacgttccggactattttatccacattggtagagcaccagtccaggggatccacatcccataatacgggaaacatattcagttccttttcatattttttatcccaggagccataaggaggccggataaaggaggtttccttccccgtcacctcctggatgatttcgttggtggaaacaatttctgctttgaattcttcggtattggctgccgtcagctgtacatgatggaaggtatggtttccaatcagatgcccttcatcactggctcttttcactatatccggatagctttccacattctgtcccgtaacgaaaaacgtcaccttcacatccctttttttcaggccgtccagaagctggggagtgcataccggactggggccgtcgtcaaaggtaagggcgatctttcccttataaggcgcctcatcctcataaccggagtccgccatcgtattcgaccagacctcctgcctttttgcgcttccattctcccgggacaggaaggtaagtgccgccacaaaaagaaacatggtcagaaaggctatccatttctttcccttcagcatgacgctgcctctttgttttttgttctcttagttactatatgcagcattcccggaaattatcaatccactttacataacgttctgcggcctgccctccagataccctgaaatattttcaaatacaataatggctctcttataaagagcttccttcgtggcaaaagccacatgaggcgtagccagcaggttgggtgcctgtaaaaggggatgctccgggctgatgggcggctcggtttcaaacacatccaccgcagctcccgcaagcctgccttcctccagggctgctgccagcgcattgctgtccaccacgggtcctctcgccgtattgatcagcacggctcccggtttcataaggcgcagctgttcttctccgatcagtcccttcgtctgttccgtcagcggcacatgaagggaaacaatatcacattcctttaacaaagtttccatatccgtcataataacgccatccgggcttttgggactccggttataaccataaacctgacagccaaaagcggcggccagctgtgcggtgcgcgtcccgatggctcccatgccgataatgccgaacttctttccttccagctccagcccgataaggcctgttttatcttttccctcccgcacggcctgattgcaggctacgatgctgcggtaaagactcagcaccatgccgaaaaccagctccggcaccgccgtattggaataaccggcgcagttgctcaccaggattcctctctccctgcagtaatccatcgccacatgatccacaccggtaaaggcaacggatatcattttcagatcagggcagttctccatcacctctttcttaaagggcagattggaaaaagcgaggatatccgcatccttcgcacgttccacaagggtctttgtatctgtgacacgagtgtcataatagacaatttccacctttcctcccagtttttcctgcgcaagtcccagaagcttttctttttccacgccaagcggctcaataataaccagtttcatccttcatttctccttttcaaaaattcagccgtgccagataacgttcttcaaatcccggctgctccgccagattcatcacttccgctctccggcacagatcctttgttttttcccgcagggagggatcccctccgtacaggcacgcgcccagaagggaggtattgcccactgcggtcactttatcggccagttctgccgggaacagccctatccgggccgctttctccacatccagataatacccgaagcctccggcaagaaatacctgttccacatcagacgcaccgatttccagcgcttccatcagcagctccacacccgcacagacggctgccttcgccatctgcagcgcccggatatcctgctgggtgatccgcaaagctcccttctgccagcctttttcaaaatatgcatcctccatcaggccgctttcatctatgatacctgtttccagcatttctgccagcagggcaatcatatccgttcccggaacgttagcagccgcccctccttcaaaggccggaccggcggctgtcgctgtgcagatcagacgcccttttccggcagccgccatttctccgttggttcccaaatcgataaacagcctgcagctttcctcccgccgttctccgaaaccgcaggcaagcagccctgctgcaatatctgcccccacaaaggcggatattccgggcagaagcccaatccgcggccccttatattccggttccggcagcagctccatttcctccaggctcacgggcgtaaatggatatcttcccagagaagccgtatccagccccatcagcagatgctccatagcggtattccccgctgcccaaataccctgcggagcttttcccagctttcggccaagctgtccgatcccctccgccagtgccgttcttaccgcttccgccagtttctccgcctgtccgtccgccgctgcctgcagtctggataggacatcgcttccccattgccgctgggggttcatacagctgtattctccgaacacatggagatttcctccccgctgccattccctgacagaagacagcgccacagcctgcatggcaatggtagttgtccccagatccaccgcaataatatatggctcatcaccacccggcatggctttttcttcaggcttccccgcagcaggctttttaatccctcccttataggcagtcactgcctccacctgcctgctttccacaaattccacctgaatacagcaatcctgccgtactctgtgcatgcaggccagccggtatccgccgcgcagctgttccgccgtaaacgcgattctgtccgccgccccgggaagaggcgctccattcctgcagaaacggatcctgcagcgtccgcaggttccttttccattacagcagacaagggaatatccgttcattttcaggatctgcagaaaaacagccccttccggggcgtcaatcaccttatcctcttttccctgctgccttaccgtcaccttcttttcagacaaattgattcctctcctcgtcataaatatagtcaatccctttaagctttttcacaattccttccttgtccgccccgcagtcatcgcagaacgcatccaggctcgggtagaaatcccttaatttcatattcataaaactcagaagcatcaccggatcctcaggtatcatattttactgcctcctgtctttctctttcagccgcatatgggctttcgttacttattataggtaatggaatgctttatggcaacattcccccgctaaatttttgttcaattttctttcatttgggaaaagtccttgacaggccgtctttacagatgctattctgatgctaagttaaaggggagtagtatctatgtacaatcaacataccctgatctgtacggcggccggaggacttttctatttttaagtctgctgccataataaacgatcatggttgtacactttctttttggaaagaacgagacttttggcgtaacgccggaggtctcttttttttatgaaaaattgtacatcctctcttcctctttcttccaccatcaaactcagaaaggatgaaaaagtatggaattcatttatgaaggattactgtccatcacccctcagcaggtcatcatgtatctggtcggcctcctgctcatttatctcgcaatcaaaaaggagtatgaacccgccctgcttcttcccatgggcttcggcgccattctggtcaatctccccctgtccggcgtcatcaatcagacaatgccgggaatcggggaagtaaacggtattatagaatggctgtttaacgtaggaatcgaagcatccgaagcgctgcccatcttattgtttatcggtatcggcgccatgatcgacttcgggccgctcctctcccagcccattatgttcctcttcggagctgccgcccagttcggtattttctttgccatctgcgctgccgcactcatgggctttgatttaaaagatgccgcttccatcggaattatcggcgctgccgacggccctacctccatcctggtgtcccaggtgctcggttcccgttatgtagggcctattgccgtagccgcctactcttatatggcactcgtgcccattgtacagcccttcgccatccgtctggtaaccacgaaaaaggaacgtctgatccgtatgcccgccaagccctccaggcccgtgaccaagaccacacgtatcctgttccccatcatcgttactttcctggtaggcctgatttcccctgcctccgtatcccttgtgggattcctgatgttcggcaacctcctccgggaatgcggcgtactgggcaatctttccgaaacagcacagacctctcttgccaacctgatcaccctgctgctgggcatcaccatttccttcagcatgcgcgcagatgcctttgtccgctttgacacactgctcatcatgatcatcggtcttctggctttcgtgttcgatactatcggcggggtattatttgccaaggtgctgaatctgttccgcaaagaaaaaatcaatcctatgatcggggcagccggtatttcggccttccccatgtcggcgcgtgtggtgcagaaaatggccatgaaagaggatccgggcaacatcctcatcatgcaggcgaccggagtgaatgtatccggccaaatcgcctccgttatcgcaggcggccttgttatcagccttgtttccgcttatctgtaatcgctgccggccagcctgtttgtattcaaagccccgtttggccagttgtccgcgggagtaaaacttgattttccgggaaaggagaatttctatgtgggataattttttaatcactctctccattatggggaaaggtatggtgggtattttcaccgtaatcattatcatcagcctggtggtggcgcttatgtgccgccttggatccgggaaaaaaacggatgaaaaaaaatccgggaaataacagccatcaagaagagccggtccgatagcaagctatcgtcccggctctttttctgttttaaattattgctctgcggtggcaggaacctcttttctgtgggcttccagcctgccgtctttcacatcaatgaggatagtatccccttctcctaccgcatcctgaagaatcagtttagcggaaagcgtctccacatgcttctggatatatctctttaacggccttgctccatatgccggatcgtaagcgttatccaccacaaactgctctgctgcaggagtgagctcaatcgtcagctccctgtcggagagacgtttgttcagatctcctataatcagctgtatgatgcccgcaatgttatccttggtgagcggtttaaagagaatgatttcatccagccggttcaggaattccggtctgaaatgtccccggagatccgacattacaaatttttccgtttcctcggaaatcattccatcctggctgatgccctccagcaggtaattagcgcctatattggaggtcatgatcaatatggtattcttaaagtccacggtacgtccctgggaatccgtaatacgtccgtcatccagtacctggagcagcacgttgaacacatccggatgggccttctcgatttcatcgaaaagaacaacggaataaggttttctcctcacggcttcggtcagctgtccgccttcctcataacccacatatcccggaggcgccccgatcagtctggatacggaatatttctccatatattcactcatatctatccgtaccatgttgttttcatcatcaaaaagagcggccgccaatgccttggccagctccgtcttacctacgccggtaggccccagaaacaggaacgaaccgataggtttgctgggatccttgattccggccttggaacggataatagcctccgtcacctttgtcacgccttcatcctggcccacaacccttttatggagctcttcgtccagatgcagggttttgtttctttcactctctgtcagcttggaaatgggaattccggtccacctggacacgatcctggcaatttcatcctcacttacgctctcatggaccagggaaagatcctcgctcttaaccgtctcttcctcgatctccaattgtttgcgcagttcaggcagctggccgtagcttaactgggccgctttttccagatccccttcccgctgggcgatctctatctggctgtttacggaatcaatctgctccctgagtttggaaagcttatccacactggctttttcattatcccactgcgctttccgattctggaattcttctttcagctcggccagctccttctgcagatcagccagacgttcctggcttaaccgatcctcttcttttttcagggccgcttcttcgatttccatctgcatgatcttcctctgaagctcatccagctcggtcggcatggaatccagctctgtttttatcagggcacaggcctcatccaccaggtctatagccttatccggcaggaaacggtcggaaatataacggttcgacaaaacagctgcgcttaccagcgcattgtccatgattttcacgccatgataaacttcataacgttcctttaatcccctgagaatggagatggtatcctccacggtcggctcctccaccataaccggctggaaccttctttccagggctgcgtccttctcaatatactgcctgtattcatccagcgtggttgcgccgatacagtgcagctcgcctctggcaagcatgggcttgagcatattgcccgcatccatactgccctccgtcttgcccgcgccaacgatggtatgcagctcatcaatgaacaggataatctgtccttcgctgttcttcacatcctccagcaccgctttcagacgctcctcaaattcccccctgtatttggcaccggcaaccagcgcacccatatccagggcaaatatcttcttatccttcagtccctgagggacatccccccggactatcctctgtgccaggccttccaccacggctgttttaccgacgccgggttcaccgatgagcacggggttattcttcgtctttctggacaaaatgcggacgacgttgcgtatctccgcatctctgccgatcaccggatccagcttctggtttctggccttctccaccagatcttcgccgtatttttccagcgtgtcataagtggcctccgggttgtcgctggtaactctctgattgccgcgcacggtggacagcgcctggaggaaacgctccctggtgatgccgtattccgtccatatctccttaatttccttattagggtgcttgatcatgctcaggaacagatgctctacagaaacatattcgtctcccatctgtttcgcctcatcctctgcggatgtaagcacctggttcagctctcttcccacataaacctggccgccctgtaccttgacacgcttgcttaccgcgttctccacccggttcacaaagtgttccttctgaatacccattttctcaatcagcttcagtataaggctgtcttctatggtaaggaggctgtagagcagatgttcttcttcaatttcctggttgccgtattcatacgccagcttctgacagcgctccacggcctccatggatttttgtgtaaatttggaaatgttcatacacatgccctcctgtaatcttctttgttttatttgttctattactactataacagcatcataatgccttgtcaacttatttttagactatttttgttttctgttttaaataaatacctcaaacttcgcacatgcccctgtcccctccggctcctgttttcgtggcgtcagcccggtttggaaatccttccctctgcgccggccatgcaggatttcctgtaaggggcgtataaactcgccggtccttaggccgcgtattttgcggccttagtaccgctgcgtgtttatccgagcgagagcgtcccctttaaggattcctgcatgtccggcgcagagggaaggatttccaaaccgggctgacgccacaaaaacaggggccggaggggacaggggcatgtgcgaagtttgagtaaataccttgaggcagatctgcagcatttaaccgcatgttttgccggctgcctcttgtacttccatcaaaacagaggtacaatttataaagaaagcgtttccattatccggaaacagcttaaaatttataaatttttaccaatcatacataaaagaaggatatctcacatatcatgaagacaaaatcatacgaaatcgacatgtgcaacggcccgctcaccggaaaacttttaaaatttgcagttccgctcatgctttccggaatcctgcagcttctcttcaatgctgccgacattgtggtggtcggccattttgccggtcatcaggcgctagcggcggtaggaagcaccggttccctcattaaccttctcgtaaatgttttcatcggcctgtccataggaaccaatgtactggttgccaactatacaggggcacaccaggaaaaggcagtgaacgaaaccgttcatacctccatattgctgagccttctgtgcggtacctttctcatttttttcgggattatactggcaaaaccgctcttgtccctgatgggtacaccggatgacgtaataagccaggccactctttatatgcagatatactttgtcggtatgcctgccaccatgctttataacttcggagcggcggttcttcgtgcaaccggagatacccagcggccgttatatttcctctttgccgccggcatcattaacgtggtgctgaatctgatctttgtcatctgcttcaatatgggtgtggcaggagtcgcgaccgctaccgtgatttcacaatgtgtatccgccttactcgtactgcgctgtctgcttcatgaaaccggctgttttaagctgtatttaaacaagcttcatattcataaggataagcttgtgcagatgatacgcatcggccttccggcaggaatgcagggcgctattttctccatttccaacgtactgatccagtcttccatcaactccttcggttccgtcgccatggcgggcagcaccgcatccagcaatctggaaggatttgtttatacctccatgaatgccttttatcaggcctgtctgagctttaccagccagaatctgggcgccaataaaaaggaacggatcaataagatactgatcacctgtgaaatacttgtctttttcgtagggctgattatggggaatgtggcctatttcttcggtgacagactgctgcatatttattcctcggatccggaagtaatccgcttcggccttatgcgtatgcaggtgatctgtacggtatattttctatgcggtatgatggacgtacttgtaggcagcctgagagggcttaactattccattattcccatgatcgtctccattgttggtgtctgcggcctgcgtatcctgtggatattcaccatattccaatggcaccggagtctgtttatcctatacctgtcctatcccgtcacctggctgggcactgccgtcgcccatttaatatgcttcattattataagaaaaaaattggacgaaaggaaacactatgagctgggaaattgaatttctgaactccatacaacatcttctgcgcaatgaattcctggatgctgtcatgcccttcatatcctcccttggaaatgcgggtattttctggattctgctcaccgtcgtacttcttattatacccaaaacgcggaaagcaggagtggcttccgctattgccctcgttcttatgctcgtaaccggaaatatgattttaaaaccgctgatagcaagattaaggccatttacagtcaataccgctattgaactcctgattcccccgccctcagatttctcctttccctcaggacatacctttgcatcctttgcgtcggccacagccatcctgaaaaataacaggcgtctgggtatccccgccataatcctggcggtactcatcgctttttcccgtctgtatctgtatgtgcactatcccaccgatgtattcttcggactgctgctcggcattctggccggactgatcggtaactttgcagccggaaagctttcctcccggctgcacctgccggtctgataccggtttgtttctttttcttctatatataaatgtacttgtaacgctgcgggactacagcctcaaagggaaatcttttgaagcgtaactgtacattcaaaaaaagcaggttccctttacggaaaacctgctttctctttgctttattttaaataaggcagttcgctgaattattcagctgcttcagtagaagctgtttcagttgcttcagcagaagcggtctctgtagcttcagctgtagctgattcagtctctgtagctgcttctgttgtaggctctacagattcggtagctgcttctgtggaagcttctacgctggattctactacgctggactcttcaacgcttgcttctacagtagattctactgcgctggattcaacaggtgctgttgtatcgctggaaccacaagctaccatcattgcggatgtcataactgctgctgttaaaactgctactaattttttcttcataattaattctcctcctaatcgaaacatacagctctaattagctgcatctgtattacgaagatgaggataacacttttctctaaacttgtaaatagtttttataaactttttaaacaaattatgaattccataagattttgttcacagtttgtacacattcatcgccaaatccggaaaaaacatccttttttctccgtttttcgcattaaaaccgttacagttcccaccagccctgcgcttcgtgtcttctgccggccggtttgctttcctgctgcggatgccctccccggcggtttggtgtaccctgcgcaggcacgtttccactctgccaaaaacgcagcggtactaagattgcacaggacgcaatctaaggaccggcgtttttagaaggcctttgcagggtacaccaaaccgccggggagggcatccgcagcaggaaagcaaaccggccggcagaagacacggagcgcagggctggtgggaactgtaacttaaaatcatccgattacaaagaattcaaacccttttatggtttttcactactccctgtgatacactgaatacaggaaaaatccaaccgggaagaacatttttcggctcggaaactatattacaggaggtaatgccatgtcttcttacttattagaatgctgtgttgactctgtggattccgccctgcttgccgaaaagggcggtgcagacaggctggagctgtgttccaatctgataatcggcggaaccacccccacgctcgccctttaccaccggatacgtatgcattcggatatccgcattcacgctttaatcagaccccgcttcggcgattttttatattccgaagaagaatttcaggttattctggaagaggtacgccaattccgccaggccggcgctgaaggtgtggttatcggctgtctcactcctgaaggctctcttcatatggaatatatgaaaaaactcatggatgccgccggcggaatgtccgttacccttcaccgtgccttcgatatgtgcagggatccctttgaagccctggagcaatccaaagaactgggcgtcaacaccatcctgacctccggacaagccccttcctgcctggaaggaatcgaactgctgaaaaagcttcagcaaaaagcaggaacaaatctgaccatcctggccggcgccggcataaacgcagatgccgtaaaaatcctgctcgccgaaacagacctgacagcctaccacatgtccggcaaacggattctggaaagcggcatgcagttccgcaatcctcaagtttccatgggcatccccggaatgagcgaatacgagatctggcagaccgacgaaaatgcagtccgcaccgtccgccgcctcctcgatacagccaattaaccctctccatatccccatactttcctatagaatttccattcacaacaaacagaatcgccataggaagaatggcaaagccattcttccagtgtgaaacttagaggttcttaggccccgtattttggggccttagaacctcttttcacacttcatacttcacatttccagaaaaaagcgctgtaggccggcagcgtacttccgccgccgaagtcatggctttcaccgcttatcaaatcaaccgccataccgcagcccgcatcaaaatgggccgtatacggctcactgtcggcatttatcgccaccagcacccgctctccctctacagctctttcaaaaatacactgtttgttagtcaggaccaccgaacggaaatcaccaaaattcagcgcccgtgaccctttcttagcctctgccagcctgccgataaattccgacaattcgttttcaaccggttccgcaaagcatgcacgaagagcctggtcaccgtcgctcttatttcctttcgctccccattcgcttccataatacacacagggaatgcccggcatgccgaacatcatggcataaatcagaggaagatgcttttcattttccagaatacttgcaatccttgtcacatcatggttatccacaaaagaaagcagatgcagccccttatacaaagtccagttttccggaccgaactgccttaacagagaatgaacgatttcgaacatattcagactgttaaagctggaatacagtcctttatagcactcataattcgtcgccgaatgaagcatgccgtcattcaccagaaccttataatctccgtgcagcatctcacccacaaggaaaaaatccggcttcagctcatcacagagactccttagccgcctcacaaagttatgatccagacaataagccacatccagacgcagcccgtctatatcgaattcctccacccaatatctgacacagtcaaaaatatgagtgatcacttcctcattctgcagattcagcttcacaaggtcgtaatttccttcccagccttcataccacaggccgtcattataattggaatttccacccaaatcaatatggaaccagttcagataaggggaattctcccttttctgcagaacatcctgaaaggcccagaagcctcttcccacatgattgaaaacaccgtccagcaccacccggatcccttctttatgaaggttctcacagaccttcttgaaatcctcattggttcccagccggcagtccacctttctgaaatccctggtattatacccatgggtatccgactcaaacagcggggaaaaatagatggcgtttgcgccaagcttctttatatgcccaatccagtcatttaccttttgtattccatcctgctctgctgccggacagcttccgtcattttcaaacggagccccgcagaatcccagaggatatatctgataaaaaacactttcgtaagcccacataaatgtgtcctcctatcactaaacttcgtcttgcccctcatgcttcgggggacatgtatacgctgtatcagtataccatatcctatttttgctttccactttttttgtttctctgctgttctccgaaggatcactaaagtggaaaaattttattcatccatccaccttttccttctgaaaatccacatccggcagtgtcgttttccacttatccatatgtgtggataagcataattcacatgcttttttcagccccattttttcctgtttctgtggataagccttttaaattatccacattgatttacataacaaaattgactgctttagtttttttactgtatatcgactatgttgtgaaaatgtgtataaccgactcaaaacgtgtaaaatcgacaataactgcaaaagaaatccccagtttccacatagttatccacaattctgactgtcataaacatgttttccacatgtcagtcttcgaaaactgcgtgtcattttctgataatccgcacattccacaattttttccacataaccaccatcccattaaaatatatagccccgggatatctttttttattcctgttactggtagttttaaaaaatttttctatggataaatcaggacgtagacatccgttcaaacctgtgatatactgacttgctgtcttaaaaagacggtcttaatttccttgtctgaaaaaaagaaaaggcaagggattcctttataaaaagcaaatagaaaaacaaatagataataccgataaacgacaggagttttgatatgataaaaataggatctcatgtaaaaatgggcggaaaggatatgctgctgggttctgccaaagaggctgtctcttatggagccaatactttcatggtgtataccggtgcgccccagaatacaaaacgtaaagccataagtgaattgaatatagatactgcctgggaatatatgaagcagaatggaattgaggattttgtcatccatgccccttatattatcaacctggggaattcggtgaatccggagacctattcccttgctgtggatttcctggctctggagctggaacgcaccattgccatgggcagccgggttctcatccttcatccgggcgcacatgtcggcgccggtgccgaaaccgggctgcgccagatcatccagggactgaatgcggtattgacagcggacactccctgctatatagcactggagaccatggcaggcaagggttcggaaatcggccgcagctttgaagagctggccgctatttatgatggggtaaaatacaatgataaactgcggatatgttttgatacctgccacgtaaatgatgcaggctatgacatcgtaaatgactttgaaggggtaatggaacaattcgacaagagactggggaaagatcagattgctgtttttcacatcaatgacagtaagaacagcatgggcgctgggaaagaccgtcatgccaatatcggggaaggcaccatcggcttcgataccttaaggcatatcgtccaccacccggattttccgggcattcccaggatcctggaaacgccctaccgccctgatccggagaatccggataagacactgcctccttataaagaggaaatcgctttattactgaatacagctgctcactaagagacaacggaataaaatggatgcggtgaatagcagcttctgtgggctgcaggttcattcctcctacagccactcatcccagaaccgctccacccggcgggccacccggtccgccgtcaccacctcgtattcctcccattctctgggaaacagctgctgataggccccgttcaggaaccggtcgtccaggagtgccacaatccccacatcctctgatgtccggatcacccttcctgccgcctgcaggaccttgttcataccggggtaacgataggcataatcaaatccgtttttaccggcggcatcaaagtagcttttaaggatttcccgctcattgcacacctggggaagccctgttcccacaatgacggccccaatcagactgtcattcttcagatcgatcccctcactgaaaattccgcccatgacgcagaaaccaagcaggctcttttcttcctccacttcaatgtccatatgaatcatatcctccagctcacaattccggtttccttcaaaacggctcaggaactgctccctgtcctcctcactcatgatatcctcctgaatgatgcattcttccgtttcaggatccagaaaattctcttcatacacttcaaatacgctctgcaaaaaagaatgagacgggaaaaaaatcaggtaattgccataacgcatcctcgtgatctcatggagataataggcgatgttgtaatattccttcggtgatctcctgctgtatttgcttgtgacatcactgcctatataaagcgctttcttcttagggttaaaggttgacttggcatatacctcaaaatcctccttttccccgccaagcaggcttttataatactggatgggcagcagcgtagctgaaaacaggacggtgctccgggctctctgcatacattccttcaggtttacagacggattcacgcagaacagcttgaccataaagctgtcatcctcttccagttccgtataaataacatagttttcgtccaggccgtcataaataagaaggaaatgggaaatttcaaagaaaaaatccagcacatcctctctgacggggctttcgtcatgctcctccagatatttttccatcgtctcataaagccgctccacagcctgtacaaaaggttctatggatcctacaatccggcagtcttcgcattcccgcttcaggggaagcagttccctgctgcacttatccagctgatgctccattttgccgtcatattcccgcactatttttttcagtgccagaaagtcttccttcaccagagaggcgctgtacatctcccgccccctgtccaccaggttatgggcctcgtcaatgagaaagatatactgtccctgcactccttccgcaaagaaacgcttcagatatacatggggatcgaaaacataattataatcacagatgatcccatcggaaaaaagactcatatccaggctcatttcgaaagggcataccttatatttacgtgcatactcctccaccttttccctgttataatgatcctcatgcagaagcagatcgtatatggcatcattgatccggtcataatggccgtccgcatagggacaggctccgggattacactccgtttcttccataaagcatatcttttctttcgcggtcagaataaccgtcttaaaccgcagctgcctttccctgagcagctggaaggtattatccgccaccgtccgcgtgatggtcttcgcagtcagataaaaaatccgttccgcctttccttccccaatggccttaacggcgggaaatacggtggagagcgttttacctactccggtaggagcttcaatgaacagcttgcgcttatggacaatgcttcgatatacataggtagccagttccttctgcccctccctgtaagagaaaggaaacgcaagctgccgaatggaggcagtcctctgctcctgccattcgttagtaaaatccgcccattttttatactccgtcagcagggcctcaaaccattcatccagctccgcccgctgataggtattcacaaaataccgcagctcctctgtttccatattgcagtaggtcattctcaccttcatctgcgcgctgtcatgttctctggcatacatacttgcatagcatttggcctgggccagatggacatccaccggctccttcattttttccaaatccctgtaagttccctttatttcatctatggtaacaacatctccattgataactccatcagcccggccttccaccaccaaatcgtaagcgggtgtgctccagctgtagcgcatcaccacctccgcctgataatcagagcccattcttctttgtatcatgcggtggatccgccctccctctgccatcgcgttatcaggcgccgcacccttacggttgtctatactgccgctgcgcaggataaattccaccaggctgcgcacggatattcttatttccacgttaccattcctcctacttgttttgcggagcaaaatgcgagtcctctgacgagcagaggaattttcctcctttttaagaaaggggtctgctgtgccgacttcttttccatcttcagatagatccaacacacaaaaactccctataaagatagtacacacttctttacagggagtcaaactttatatagaggtacaataagtttcacgaattaagcttcgtttatactttagcaggcgattgcaaaatttctgaggtaactgtcgaattctttgctgtatccatgacaggttactgtcagtacacgggtaaggtccagtccatacacaccaagaatagatttagcgtctaccacatagctgttatatgctatgtcaatatcgaaatcacacctggaggccgcgtttacaaattcctgtacctcgtccggtctcagcacaattttatactgattgattcctttcatacttaccactcactttcatcctttcttaaaatatataaacagataccgacacggtgattttaccatgttcttacttggatttatcatattatacagcattggcaagaaatgtaaaccccccatttttcggcatattctgccagtaaaatcagccatactgcattatgtccccgcaaagagtcaaacctgctcccttctttgtctaaaagtatgatttccggtgtttacccctattttgtcccctccgatttctgctcattctttacaaattctatcatatattcttggaacctgtaagggaggttctgtctctgcaatttctcattctcccgctcctttatagttatcttacggcagaaataccggaaaagttcctgaatattccgctcttcctctgagaattccaaatcctgcttttgtggcccatgctccagtttcgccataaaccagggctttccggcctggtgaatgccataaagctttcttcccttatcataaataataaaattttccttaggaaaccgatcggcaaaatgaggcatcataaacggaaccacattgttcttaggtcctatctccccaaacagaacacctcccgtagtttcttcaaaacgcaggaaaccaagaagatgatgtgcctcatttccggccgacctgctcaattcaaatacccggcgtacatccgaattccccagatgatcctgcagctgccccctgaaccttcccttaagcccttccacaaccgcctgataaacggcctgccctttatccatttcccaggaagaaagggcgtaacagaactgttcatagcattcctccccgaaacgggaaagtatggtccgcctcaccttatccgccttctgcatatccggtattatattcctgtattcggcaaacaggcggagattaccatcctcccccacctgtatataagtactgtcatgatcacatttcaacgcatatgcatcataaatcccggtaaaaactccctcctgggaatcttcacaaataaatatctgttccatgccttcggcacctttcctgtcatatcagacgcactctagcccagctgactgattccctgctgcctcgccgcaaaacgcacatcatcaaacagggaaagctgccggtaagacattcctcctgcctctgccggaagcttttctttcacagacagcaggttgcgcgtgatataatcctcttcgattctcgtattatacatcatacgtccctgacaggttatgaaataaagggctctcttaagaaccacccctattttcttcaaatcctcgaaacgcaggtttgcactcctcctggcctttacaatcctctgggcactcttcaccccgattcccggcacccggagcagtgtctggtaatccgcccggttcacttccacaggaaaacattccagatgacgcagagcccagtcttccttgggatccagcagtacattgaaattgggcctgttttcatccagcagctcctccgcctggaaaccataaaaccgcagcagccagtccgcctgatagagcctgtgctcccgaagcagcggagggcctcccggcagggccggaagatccttatcctcattcacctggacgaaggccgaataaaaaacccgcttcaggctgaatttatcatatagattctgggccaccatcataagctggaaatcgctctcacctgtggccccgatgatcatctgtgtggactggcccgccggtacaaatgccggcgcatgcctgtaaacggccacttcattcttgctctcggttatcccgttctgaatcagccgcataggcgccagaatattcttcctgtgcttattgggggcaagcttctttaggccttccgccgtgggcagttccaggttcacactcatcctgtccgccaggaaaccagtaaggcgcaccagctccggattagccccggggatagcctttacatgaatatagccctggaagttatattccctgcggagcttgaaaagtgtccggtacaaaagctccatggtataatccgggctgtacagaataccggagctcaaaaacagaccttcaatataattccttctgtaaaattcaatcgtaagcctgcatacctcctccggggtaaaggaagcccgcagcacatcattggagcagcggttaatgcagtatttacagtcatatatacattcgttggtaaatagaatcttaagcaggctgatgcagcgtccgtctcctgaaaaactgtggcagatccctgcctttatggcattccccattcccgtaccgtccccgttccggtccgtcccgctgctggtacaggccacatcatacttggccgcatccgtcagtattcccagcttatccattatgctcatctgcttgtctgaaattctgcactccattttatccctgcctctttgcttctgtcttaacgcctattacgaacatatgttctatttccatattatagtacatacgttcgatttatgcaagtaaaagtatatatgaaaacttatttctcaacaccatgaataatttcagtacatatttaactaaatgtaataagaaatcctgtgatgtttttaaataatatatgttcacggaagaatgttcacactttccgccttgaatttactgttttcatggagtaaactacttactgaaaaatgtcaaattgccactgctcagtcagatgtcaggcagctgccaatttttaataccaaaggaattaaatggtatggtattatcaactgacaatgaatttaaatcagaattccgccaaaaaatgagttgattaaagaggaagaaatgcaggaaattagccaaaacaatataaagtcgtatcagaatacttatttatctcattcagagaaccgtaaactgcagcaggaatatcacgaaaaatccatttccgaaatagcctttcaagcttcgaaggctttacagcatccatttatattttctgttgacctgccaaccatgagtgcagtatcacagggagccaccggacgctgctggataatagcgggtcttaatctattgagggaagaagccgttaaaaaaatgaatcgtgaaaagcttcccaacggagaattcactttttccgctgcttatttatgtttttgggataaactggaaaaatcaaactgctttctggaaagggctattgaactgaggaatgaaccgtatgatatcagaactgtaaattcatggtttcaatatgcggttacagatggaggcttttggacttattttacagatctagtcaaaaaatatggagtagtacctgctgatgcaatgccggaaactattcactcctgtaataccgaagaaatgaacagccgtttgaactgctatattcgaaagattagtgcggacatccggaatgcggcgaaggccggaaaggatacagatgatatttacgctataaaagaacaggcaatgcacaggatttactctttcttatgtctctgctatggatatccgccggaatctttcacgtttgattttatctgtggaaaagaaaagaaagagtacacccccagtgaattgtatcaagagcttttagaaggcttcccagataactttgtcagcgtaatttcattaccatatgaaaatcttccctttggaaagccatgcagattagatgatgtttttcaagtagcaggaatgcatgatgaggttttctttaatctgccaatagaagacctgaaagcttgttgcaaacaacagctgaagtctgggattcccgtattttgtatggcagatgatgacaaaatgtgtgttgatgaattacagctttgggatgataaatgttttgattacgacagaataacgggattttcctctgatatgagcagaaaggattatttccagctaaaagcaggaatggcaggtcattccatgctgattacaggtgttgatattgccagggatggccagcccgtacaatggaaatttgaaaattcatatgatacggaaggacttcataaaggctattttacctgttcggatagctggtttgagcgttatatggtcggcgccgtaattcataaagattttttaaaacaatatgaccttacaggaactgcagagcatacctttcgaatctgggatattttatgaatacatcagtctcattcgttatctgcataagccacatgataacgaatgagcaattgccttgttccgtcaaagtaactattcttatataatccccatctgtcttgctttctccaccgccatcacccgcgacttaacctccagcttcctgaaaatgctggctatatggcttttcacggtagaaagggaaatataaaacttatccgctatatccgtgtttgtcagcccatctgctatcgcctgcaggatctcagcctcccgtctgctcaaaacacatgtgttctccgcgatacacagccttacagcctcctcaaaaaagagcttttcccgtggggacagcatttccgcaaatgcgctgccatatttctggtaaaatccatatacggtttccgcttccacaaaaaagggctggaaaatcctgttttcacaggcataatatactgcttccttaaacagatccttcagacgcctcgtatctgcggcacattttgataaggcagtccctttaagcaggctcgcttccactatcttgagagaggatttccgtttacgggctgcggcaagcacctcatccaacacagacagggcatcctgaatctccccctttccaatcaggatgcgcgcaaataacaggctgctgttcagtgaccggcctgttttttcttttcttaaataagcatccatataattgtcctgcattgccggtgtcatgacacccgcgcggaattgatatttcaacagggatgccagcataaggatatccttataataatccgccgccatcaggcttttgagcatcgcatccgcctgttctgtctcccctagtaaatataactgttcaatcacattaaaggcataggaaagccggagctgccctccgcgttccgccacctcttcccggcattcctccaacaattgaccggcatcctccagccgcagctgcttcatgtacagcccggcgacagtcacgttaaaagtaggaatatggaaacgtctcagcagttcatttccctcaaacagattccttgtctgctcctgcaccgccagtgcatcgttcaaaagccccatttcctcacagatctgtgttttcagggtctggttaaaataggcgacgtaagcgctgtggttctgtgtttcaaaggcaatgcttttctgaaccgacgcaagcgcttcaggaaagcgatccctgcagaataaaaaggcggcgttcttagtcaatatcaatgcctttgttaaaggatgcgcctccatctcaagaaccttatccacaggcatcggctcctgaatcatataaggctcttccctgtataagatggccgccccataaaaggcttcatagcgcggatcctttccggccctttccgccgccgcgttataaagcgcatcacatgaatcaaattcaaaaataaagtaatgataaaaaaacttctgaaaagccacctcaaaatcagttacagcaatttccacgggaagcctggctatgtagtaaaagaaagcagggctattgtccatctccagaagccttgtcatgacaagggtgaaatctcccagtgaaaacaaatggcgcaggctttcatcctgatccccacattcccacagcgctctcgcccctttcctgagcacctgttcctttgtaccgtcagccagcctgtcaaaccgaatacgcagaaaatccctgagtaaattatggtacctgtaaatttcttctgcttcatccacacactgaagcatcaaatttttacccagaagtctctccagcatgctgtcaaaatctatttccggcaatacacacgcaatgatccgtctgttaaaataagaaaacggcgcagtgagcacaagaaaggtctgttcctcctgtgtcagctgtccaaatatctcctcggctatatagtcattcagataccggttatccctgacagtccccttagcaaaggtaaccctccccgcggccgccagaagctgcagaccgccaatccagccatccgccttatccaataccccctgcagttcctcttcattacaggacaaagacaaggtttcctttaaaaagcaggctccttcctcctgtgacaaacgcagctcctcatcctctatgcgaaggagctcatccttcatttcaagctttgacagggaaagctccggcagcgcacgggtaagaagaaagatatgcacattctccggcatattcataataaaataatccacgctctgaatcagttccctgttattcagcagctgaaaatcatccatcacaaaatatgtctctcctgtctgctccagcgcattgatcagcaccttcagcatttccgtgtatccggcgcccaccccctgcagataagttgaaaactcatccgccgcagcaccaagcgaatcagacaaagcctttaccacataattccaaaacagaggaataaaattacattcatcatccagggaaagccatcctgccgacagctccctgttttcaagataagaagtgagcagagttgtcttcccgctgccggcagcgcccattataacagttaaacgcttgtgtccggatgcatccagtttttgaaataattccctccggagtaccgttcccattctcggtttcggcatcataagccttgtggataacaatgtcctgttcataaacgccccctcttaaaaagattgttattcaaattccacatatcttcccatgctccccgcccgctggtaccgcgtctgccgcctggcttggaatccccttcctgcctgccgccggccacggccttgcaggggatcctgtaaggggcgttataagcacgccggtccttaggctgcgtattgtgcagccttagtaccgttgcgtgattatccgagcgaaagcgtcccctgtaaggacccctgcaaggccgtggccggcggcgggcaggaaggggattccaagccaggcggcagacgcggtaccagcgggcggggagcatgggaagatatgtggaatttccgtatacttatatttgttttcagtgtccgatataagtcctttttgttttccatacggagaccgtatagaaaaccgcaatcagcaggagcaaataggtaagagacggaacaatgccctgccatgccatgtgccgctccacgccatccgccacgttcaggaaggccttctgcggaagtatctgtatgatgactcccagcgcctggttgcctttgtcaaaggcaaagaacccgcctgccaggatggatgtgagaattatgatcgtattgccgatcatttttgcagaatcatccttattcggcagcatggaatacaggaaaaggctgaatacggtggacaatgcacatataagggcgagcataccggcaagcggaaggaaaccgaagccgaaagccgccccgcttatccattttaccacaacaagaatgatcgttgtaggaataaagagaaaaaggaagttgaacaggcagtgggcaaacagataattacttatccccaggggcgacgccgctatccgggttatctggccgccggttttgtcatctgcgtaaaaggtcatgcatgtggaacccatcatcagcaggaacatagtcaggaagcccaggacattggttcctgtgccgcggtcactgaacatggcaggagaatcctcccgcccttccagcgcagccttcagttttgcagtggtttcctcgcttttgacggtttccagtgaacagcttccgtccgcattcttcatcagtacagcatcataccggcccattacaagctccgaacggggcggggcttcctccatctgaatgatatttacctgcttcgatgccaattccgcagacgccggcgaaacaactgccacatcccatttctgtgtcatcccggtgctgacaaatactgcggcgcaggaagctgcagcggtgaataacaccagcaatactataatctgcttctgctcaagaagccgtctgaaattatttttcattatcactttcacaggtaatcctcccgattaaataatctggctgtaaacacaatacatagcccgcccaacaggcacagcgaaacacctgttacgcccagtgtcagcatgtttccgtcataaatggccctgaaggctgcattgcttatccatgtgaccggtgaaagattgctgattaagctcactgtgcggccaagccctttcagagggaagaaggaacctcccaataaacagaggatggcgaccgcggtggaaagaatcatgttgaccgtctcctcatgtttcaggatacagcaaagcatgatgctgaaacacacggcaaagaattccacacagagtaaaaggatccataagtaaatgacggtctttcccccgaagctgactcgggcgatgaaaaacagcatggctccggcaatggtatggcagacagcaccgaacagaaacgatgcggcaattttaggcatatagatataggaatccggcacaggggcattacacaggcgcatattcgcctttacaatacgtgtttccataaaactgttcgcagcaagggttgcattgtttaacgccccgaaaatcatcatggtaatagcataataatcaaaggatgtcaccacgccgccgtaagtgcctttcgtgataaaccccatgaccagcgccagcagcagcggcagccctattgtcccggcccaccacatgggattcgtgtacaggttttttaaatccgttttcagaatacagttaaattcatacataatcgctcctaatcccgcagggaacgtccggtcaggttcaaaaataccgtttccagactgattgcctgcgtggtaatgctgttgatgcgctttccatgttcaatcagtacggcaatgatccgatccagattttcaatgcccggaatgacggcaagcttcaatgttccggcgcctgccgatacttttttcaccccttctatgcggtacagcgtatcggaatcgaaagtatcaaggccgtcggcttcaatggttatcattttatccgtatcggttctttccttcaattcctcctttgtgcccccggcgatgattttgccgtggtccatgacaataatccgggtggatatctcttccacttcctccatatagtgcgtagtgtagataatggtcatcccctcatcccgcagacgtttgatagattccaggatatgattccttgactgcggatcaatccctactgtgggttcatccatgacaagcagctccggcctgtgggcaatagcgcaggcaatattcagacgcctcttcatgcctccggaaaaggtaccggccttatctcccgccctgtcggtcagtcccgcaaatgcaagggcaaaccggcatccttcctgcagtgctctgcctcttaaaccatagagggatgcgaaaaattccacattattgcgtgcgctcaaatcctcgtagattgccagatcctgcggtacgacacccagccgccgtttataagcgggtaagtcatcatggatgctttttcctttcaggaagtccgcatatatgccgcctccatcccatcccagcgcaccggtgagcatattgatggtcgtgctttttcctgcgccgtttggtcccaatatacacaggatttcacctttgtatacatcaaaactgactccgtccacggctttgcctgttttataacttttcttaaggttttttacttctatcattttattcatataccgctcctttcattgtctctattgtaaaccagcaggcttaagagcggtatcggccgaaagtatgattcgggctggccgggagtatgaaaaaacggcacagccctcataaaggccgtaccgtttccgaaatcttctgttcttttatgaggccaccgaccctttgaagccgatgcgaatccggctgcgtcttccggcaagggccgcctggtacacagcgcatactttatcaccgaactgtctggctccgaaatccaggccggtccgaacggctcctgccgacaggaaatttttccagtccacatcacccgtaaccttcagacatgcttcactgaattcttcaaatgtttcgtactggtatccattttccttattttttacaatcccttccacacaagggtctttcctgcacagtaccggcagaccgctggctaaagcctccagataggtaattccctgggtttcgctttgggaagcgctgacaaaaagatccgccgcccggtagtaagctgctgtttcatcaggggatgccattcccgtaaaatgaatccggacactgtttttctgttcatcggacagctgttccagttcttttctgcagggaccgtcccccacgatcaggagttccatatcatccctgttcatccgcccgaagtacgtgataatttcttctatatttttttctttggcaagccgtcccagaacaagaagtacctttttcccttcttcgattccgtatttttcccgtatttcccttctgtcacgctccacggcttcccagctcaccggcaggaaacgctccagccgtataccggtgggaatcaccgcaacaggacgatccacgccgtaggaattaagaatcccctttaccttctgggtgggagcaataacaaaatctgttttttccagaataaaccgtgaaaaccatgcggcagcctgctttccccatggccttcccgcgctgaaataatgggtataatcttcatacaccgtatgataggtatggacaatgggtatccccagctgtgccgctatcttccgggcaaccaggaagctgctgaattcacactgggaatgaatgatatccggctgccatgcaatcaattcctcatacagccggcttcccggaaagcataccgccctggctccgggataaatccggcttatatcaacagaacgcatgtaatagacatcttcctccttgtaggagtgtccccgttctgataaagtgacaactctcacttcatgtccttttcgggtgagttctttttttaaggtaagaacagaggtaacaacaccgttaatcacgggttcataccaatctgttgtaattaatattttcataggtcccctcctcaaataagctgtcgtaaatttctgccagggccgttcctattttagtaatactgttttcccggaccagctgatatgcttcctgtgtcaaatccggaagctgtttttccagaataaccggcagaagctgttcaaaatcttcccttccctttcccttatacacggtcctgtcatgctccagccatccctcatataccgggatatccctcaccagaactggcgtctgcatggccatggcttccagcatgacgattccttccgtttcctccaatgtggggaagaaaaataaatcgcttccgctgtaggcatccatcagttcttccttgctgataaagcccggaaactgcagattgggaagctgcgtcctgacagccttccggattcgggaaggaatcagagcggacggcgtggaaccaaaccagataaactcatactgaggatatttccttgccatttccacaaaatccaggatcccttttctttctatataatgtcccacccccagaacaaccttctgggtggatgtaaagcaataagctctgcggaatctttctgctccctcttcgctttttttataggctgcaaggtcaataccgttggaaagaggcactatctccctgtttatcccataggtctgcagcagccgtgcggaatagggtgtgggcgttatcaccacatcaccgcttctatagcaccgtctgatccaccgtcggaacagccctgctgccatgttggaaccgataaaggaattccggaaatcctccatcgtagagtgaccgtaataaaccacccgctttccctccatacgggctttcagactcatccacagtgaatcgggaaacacggtattcaaatggactacatcataatcctccttcggatcaaaggtataaggtatccccgcgctttccagtgcccgtgcctgatgctccatggcgcgtcccacgccgctcttgcctgccacgttcataccgccgttataaagtaatacttttctcattaccgcaccctcttttcttctatcttaatatacaggttcatcgaatcaactgcaggacctgggtaaacagcagctgcagccccagggaatatgccgcaatggataacggcttgccgagcaggattataagcaggaatttacggaatgacatggaggtcacgcctgcaaggaagcagagcagatcatccggcgccgccgggaagaaaatagccagtgcaaaccatttatcaaaggtaccgttttccatccatttcagatattttccatatttctggccgtccgccgccttttccacagccttcatccccagtcttctggatatctggaaggcacaggccgacccgatacagattcccaggtaattatagacaaatccccacagcggcccgaacagaagcacgccgcccagacaggaaactccgcccggtatgatgggaatcaccacctgaactatctgaatcagaataaaaatcagaggcccccatatcccaaaaggctttaggaactgctccatagcttcctgagaggtaaacagccccttctgcatcccatatatcgtaaatgctgcgcagaaaccaatccccagagctgtaatgatataggaaggttttataaattttctggtttccaccctcactttatattccgctttcggtttgaattctgctttttttactcctgccgtatattccatatcctgctcctgttctccttatcaatagctgtcctgtctgtcattcattgtctatatgctaacagtcaaagcttaaagaacagtccggtaatttctaaatatttctttaacaaaactggtattttcacttaattaaacggctcataaaacataaaaacagctgacatgatctggaaaaaagaagcatacaaatagtaattcttacattaaattatggaaatatatagttgatctattgaagtaatttgaatataatgcttctgtagctattaatattccggcataagcgtgccggaaacaatgtacattatttttttacaggagaaaagaaatggaaaagaaaaacaaccttctgaaaatcgcgtcttatatattgatcgcgtttgccgcaattgcccttgtcgtatctgtggtgaatattttcagaacattaggacaggtcaacaatatggacgccgccacgcaggccgcgctggatcaggcggttgccgccaatgccggaagcggagtgtccgcagatatggcagtgggactggtaagcggtatcgcatatgtgactcttgcgattacggtggccttcaatgttttgataatcattatcggaattctgggaattaaaaaatctgaagtgatgggcagcaataacttctttatgatatggggtatcgttttccttattttcggtgttttcggcctggcaggcaccttgtccctcatcggcttctgcaacctgatggcaggtattgccgctccgctgctttatatcatcttttccaagcagaccaaagcggcctgagacgcggtaaaagaattgttatagaaaaatacataaaaaaacagcccgtctgcaaaaggcttcactccgtcaggagaatgcctgttttgcagacagggctgttttctttattccatctcatagcttgcgggtggactcctgttccaggagcactccgggaaatattttatgctggtggccgcttcttcctgccagtatatcaaacagaagctttacggattcctccgcaatatcctgcaccggctggcgtatagtagtgagagtgggattataatagctgcaaagctcaatcccgtcaaaaccggccacagaataatcacggggaacatttttcccttcttcaaatatggcacggcacgctcccaccgccatggtatccgaaagagcgaaaatggcagtaaactcttttccggaatccatcagttttctggtcataacataaccgctttccatggagtaagacttgatttcctcaggcatgtggcagattaacgtttcatccacacgtattccatgatccttcagcgccctcttataaccgttaagcctcatcttaccaatactggcatcgttgggacgcgccgccagtattgctattcttgtatgtccctggcggatcagataatccgtcatacggtagccttccttctcgtcatccaccgacagagaggaataattatcatgatgcattccgtcaggcgcacagcccacggtagaaagaataaaaggaatatggagcttacgcagcttctcatccgaatgggaaaaataccctcccaggaaaataatcccggccagccttttttccttcaccagttccagtgctacatccacctcatcctcattggattccacatgccggataaccatggaatattttttccttttgatttcatcctctatgatctggatggcgtccgcaaaaaagggattggtgattcccttaaccagcacagcaatacattttccatccgtgcgcttcagatttctggcgctgttattgggaatgtacccatgcctccggattgtatccataatcatctttttggtctccggattgatatccggatggttattaatagccctggatactgtactgacccccacattacagaacctggcaatatccttaatcgttatttcttccacatcatgttctttcctcatactttaacatccatcccccaagtctggcgtcatatttgcaggcttcgacagaaagcctgcctttattctataagacagctttggtataagtcaaccctgtctgttttaccgcggctttattaaccctttaccgctccggcaacaacgccttcaataatatatttctggcataccaggtagaaaatgataatggggatgatcgccaataccaggactcccatcatggctcccatatcgatggaaccataaccgcctctcagatactggacagcaatgggaattgtcttgtattttgtcatatccagcaccagataaggcaggaggtaatcgttccagatccacatggcctgaaggattgccaccgtgatgcaggtgggtttgagaatcggcatgacaatccggaaaaaggtctggatcggcgtacatccgtcaatcatggccgcctcttcgatttccagaggtatactcttcacaaaaccgcagaacataaataccgaaaggcctgccccgaatcccagatagaccaccacaattcccagaggattccccagatgaagcatatctgccagcttggaaagagtaaacattaccatctggaacggaactatcatggaaaacaggcacaggaaatacaggcctgtggtaaatttattttttaccctggaaatataccatgcgcacatggatgtacaaagaataattatggcaactgataaaacggttataaacagagatgtccagaaggcatccacaaaaccagtctttttaataccgttcacatagttttccagtcccacatacatcttatccgtaggaatcgcaaaaggctttctgctgatataagcctttttcttaaaagaattgatcactacgagcacgataggaaatacatataccagggatatcagcgtgaatacaaaagtcagaagaccgccgtgctttgcttttctcgcattcattactgctgtacctccttccttcgtgtgagtttattctgcgccagggcaataatcgccaccaggatgaagaataccactgccttcgcctgccctacgccctcccagccggtgcggccgtaaaaggtattataaatattcaaagccagcatttccgacatcttggacggctccccgttggtcaaagccaggttctggtcgaacagcttgaaggagttggtcagtgtcaggaaggtacagatggtaatggagggcatgaccatgggaatggttacattcctcaggatttgcctggaattggctccgtcgatcttcgccgcttcgatcaaatcccctgaaatattctggattcctgcaatgtaaatgatcatcatataaccgacctgctgccagcacatcaggactatcaggccccagaagccgtatgttgaggaataggtcagcgtcctgttaaaatacagcagtataccgttgagaagaagctgccagatataccccagaataataccgccgataaggttcggcataaagaacactgtcctgaatacattagtccccttaaagccttttgtcaaaagcagcgccacggtgaaagcaaggacattgatcagaatcaccgataccacagtaaagagcgccgtataccacaacgcatggacaaaggaagggtccgtgaaaattttaagataattggaaaaaccgataaatttggcatccgttaccgtagtgaacttgcagaaggataaataaattcccataataaagggagctatgaatcccagaataaaagcaagaaatgtagggagcacaaaaatcggccaataccttttgattgcttttgccattttctttcctctctttataataagtatacatctgttagtatgaaacagggcgggcaaactgcgcccgcccttccctgaacaactgctggctcgcaaagcgcggcagccattgttttatatcttattctgcttcatttgccgcatcatattcggtcttccagccgtctacgaatgctgttaccacattatcccacttgcctgttccctgagcatactcaagaagtgcgctgcccagaccgttcttccactcttcggaaggcatagttgtgaagttccatgatacaggtgtttttccggcctttgtatattcatcattggcaagaatcagcggattcgttgactgatagccatctgcaaaggtcttgaaaggagtaacaaagcccatcttgttggcaagagcgtcacgtccttcgtcgctggttactacccagttcaggaaatcaagagttgcctggatatcatccggagcagcgttcttatttacacaccagtagttttcagaacctgtgcagagtccctggttctcttcaccttccactccaatatagataggaagcattcccagatcctcgtccgctacttcattgtctttgatatcattgtaagcccaggtaccattctgatagaatactgcttcgcccagtgcgaattcagaagcggcgtcttctccggtctttccggaaagaaggctgggttcacaggttgcatctgttatatacaggtcaaaaatctgtttgtagttgtccagataagttcctttgattgcaggtgaggaggtaattccgtcagccttgtattcataataaacaggaaggtttgcaaggtgggtcttgaatctccagtcggaagaagcatcaaagcctgcggatgtaaatgcgccttctactccaagatcatccttatgagcctgaattccgtctgcaacctttttcagtgcgtcaaagttattcagttcatcgatggaggtgatttccgcatcgggaagcgcgaaataatcattcagcagagccttgttgtaaatgataccgtaagtctcgataacgtatgccataccaagaacggaatcgccttccttcaaaacatagtcatcgctttcgatattcttgtaaacatcgctgtccttcaggtcatagcagtaatccttccaggaagcgaggcctacaggtccgttaacctggaacagtgtaggtgcttctgatttggccatttcagacttcagtgtggattcataggttccggatgctgctgtaactactgttaccggtactcctgtctgttccgtatatactgcggccagatccacccaatcctcagcctgctccggtttgaagttcaaataataaaccttgccttctccgcttgctgcgggagtctccgccacgctttctgccggctcggacggctctgcttcagaacctgcctccgcctgcgtatccgcaggtgccggtgtgctttccggctctgccttcgatccgcagcctgccagaagagctgaaaccatagctacactcagtaatgcactgatcagtttctttttcataataatctctccttttccttgaaaagtgtatttccggaaacgttgtcggtaacgtttccaattgctatggttgtatattaccacatagcttttctaattgcaatacgtttttgtatatttactatatttatttttatttttacaatttcaaatatacactttgtataattatgagtttttttcacacttttctctcgttttttacaacttattttttgcattttttcatcggaaatatacctgatatttataattctaaacatttttacccggattatacaattaaaaagcgcataaaaattcatttcgctttaccggatattatatggcagaaaaatggcgcccgataaagcttctgtcttctccttaattcccgcaaaaaaagaagcccccgctcaggacttcttctttcgttcttacagcatatacttttccatgattattgcggccccgtcatggtcgcagtcatccgttatctccttcgccagcgccttaaccgcaggaaccgcatttcccaccgccaccggcaggcccgcggcccgcagcatttccacgtcgttactgttgtccccgactgcaatcactgactccatggggagcttcaggtgtctgcacaaaagcttgaggccttcccccttatttgcctcccgggcgttgatttccagatttcccgcaagagaacttgccagggaaaggggaagccgggaaatcttctccagagtcctgcggcggctgccgtcatccctgaaaaacagatttattttttccacctccagcggcttctctctgtagaaagaaaacagactgtccacccttaccacgctctgccggaacactttgtcaaactctccgaggccgaactcaccgaggcgctgcatataaccgctgtccataaagggacggtttcccatgaaaaatgaggtcaggatatcctctccttccacacattccattacctcaagcacctgtccgggcggaagaggtatccttgcaatatgttcctttttccgcagatcgtaaacacatgcaccgctttcgcacaccagatactgcatggacggaaaggcatccagataagcttccatttccccgatgcatcttcccgtggaaaaaaccacctgtttcccctgccgcagtatttcttcgatggccctgcgggccctgggcgttatttcctgcctggaattcagcagtgttccatccatatccaatgcaatcagcatatactcctgtttattcattcataatctcccatcctgccgtaatacctattgatagtttacaatatttccggctgtttgtcccgtgtttttttatggcagggcaggcgatatgaaaaaaggaagggaattctctttctccccttcctccggaccatcacatgcattattcctttttattttcaaaataaactccgccgacaacaccgaccacaataatcactatcgccagaactgaccaaatatcccacatctgcagctacctcctgtccgctatttgtttcttaagcaatacgatagcatgacaggcagaaaaatacgatattctggaaggttctttaacattttatgaacgtggcgttagcggcatcttagcaaatgcccttttaagtacaagacagcgtctggtaaccgacagatgcaccagctggtttttatcaaataatacatcatagccgttaaaggttcccctgatttcattaagctccacagggactcccgcctcggcgaggcgatctgcataggcatttccttcatctctgagacaatcaatctcctgtgtttccacataagcgggaggaaggttctccagggacggagcgcacatgggagcggcatactgcggcttgccgaaaacgcccgaacgcagatacagatcccacatctgcctgttcaaattggcattccagccgggcgaatctacaaactgacgcatggaccagtagctcatgcttctgtccgtaaccgggtttatcagcatttggaaacagatggacggccccttcctatcccttgcaagcaatgtaacagcagcagccagggcaccccctgcgctgtctcccacaaccgcaatcctgtccttatctattcccagcttttccgcattatgggccacccagaccaaagccctgtagcagtccttcaccggtatggggtaaggctcccccagacggtagtgtacgataaccaccttgcaccttatactttctgcataaacctgggccagccggtgtgtggaaggcctgtcccttaatacaaacgcgcctccatggtaataaaccatgcaaggggcatttttacttatattgacaggctcatatatggttacccacaccttgccgccgtccgccgattttatacatttccttttcctgcgcatccctttggcaggccgctgcaggaaacagccggcctggaaccatttgttggcaagccatatttttttgggcgttataatgtaatccctgaaatcgacgcggctccagagaccacctacatctttcaaatccttatccaatgcatattttgaaaacatgtatcccttgtgcataacgattccctctttacaaataacacgctacactacattaccgtaataatatatcatacctgcggttgtaaaatctaccctttttgcaaatttcacctttttacacccaaattggactttttattgtaaccttcctacaaaggaatatttttagcataatttggatatactttttgtacaaaaataatggcaaaaaaccgtctttgtgtctttcggttaatggaggaattatgttcggaaaaaaaataaaatttgaaatttggggctttctatttactgccgttttaggcacacttctgcattttctgtatgaatggtcaggaaagatgcctgcagcagcccttatttcccctgttaacgaatccgtatgggagcatcttaaacttttgttctttccctttgtcctgtttaccctgtgggagcttctgcatacctttcccgcccccgcctgctttcttccggcaaggactttgggcttaagtgcaggattgttttccattcctttccttttttattgttataccgccatcctgggaaccaactatctggctctggatatccttgtttttttggtgagtatcctgatcgccttttctgtaagcggatttattgaaaacaaagcggcccgctccgccaaggaatccggcctgctgtgccgtatcctgctttatctgtcaattgtggttttacttgttttactggctctctttcttttctttacctttaatccacctcatatgcctttgtttcgcgatccggtgaatggaagctatggggtttgagatcttcagccagtcttttgccttcccgcagcattgttttcttctcttttttaataataataaccagtaaccaatgccttcctttataatttatccggatggaaatttgcttttagccggttacccgagtataatcaatataaagatccaacagtaacccaggtgctgaacctgatgataaaaggaggctttttacaaatgaggaaaaaaatcatagctttattgaccgcggcgttattattcagcgctgcaatacccacaacagtaaatgctgcaggctttgtgcaggataccgccggtgtaaaataccagaatgatgacgggacgtatgccgcagattcctgggtgcaggtcggtgcaaatatctatcatgtggatgttaatggtattgtccagaccggatggatacaggtgggtggactctggtattttcttgatgatacaggtatctgcaccaatccggaaggaaccgttacccctccggcccaacagactgctgaggctgtccctcaggcaaatcctttcgctgcggcaggctggagcgtatatactcccacagatcccgcttccttgcagaatggtgttgcagcagggcttataggatttgatggagcacagtattgggctgctccgggatttgtatctgccccggctccggctgtcaatcctcaggaaaaaatagtttacgtaacaaatacagggagcaaatatcacagagacggctgccgttatctcagagaaagtaaaatacctatgaattatagtgacgccattaaatcatatactccctgcagcgtatgtaaaccatgatataaacagcaaaaaaacaccaatgtgtcagcactgcaattaaaatagcggataactcagattaatactgagttatccgctgtttgtactgaagcacgggggattcgaacccccgacaacctgattaaaagtcaggtgctctaccgactgagctagtgctcctcatcctattctgttacctttccccgcgttataaaaaattatacctccgggaaaaaaagaataaaaaaaagaatcataagaaaaagattccttttctgcaactgggctagctggattcgaaccagcgaatgcaggagtcaaagtcctgtgccttaccgcttggcgatagcccaagaaggtggataaagggattcgaacccttggcctccagagccacaatctggcgcgctaaccaactgcgctatacccaccatatggattatgagaattatcataaccacaacgtgctcgaagggattcgaacccccgacccacggcttagaaggccgttgctctatccaactgagctacgaacacatattacgggaacgcctggcaatcatgcgacaggactattctgactgatgctgacagaaaactgtcacacggataactgcttattaaagcttgtccttactgtaattacctgctgcattcaggcaatccgcaaaggataatcatccgcaagcgggtgatgggaatcgaacccacgtatccagcttggaaggctggtgttctaccattgaactacacccgcatatatataataaaaatcgtgtgaccagagtatggtaatcggggtgacaggattcgaacctgcggcctcctggtcccaaaccaggcgctctagccaagctgagccacaccccggtttctgctcacccttagccgtgacgcagaagttattatataacacccgcaaacatatgtcaacggattttttgaattttctttccaatttttttacaaaaaattcaaatgataatgtacctggccatccctgtccagatccatgattatataagaaggctttcgtccttcctggcgcgggaaagaaaggcttcccgggttaatagcggtaatatccttgtccacgtcaatgacaggcttatgggtatgcccatacatcacaatatcgacccctctggcccttgcctcctccttcagtatggaatttcccatggacacataatagttatggccatgtgtgagccataccctgtagtttcccacattaaattccctttccctcggaagatccgtaaagaaatcattgtttcccgcaacgatttccaccgggcagtccacaccggccatataaagctcctcgctcccctcagtatctccgcagtgaatcagcatgtcaatgggttttatgcgttctatcaaagcaaggaatctgtcatctctgcgatgggtatcgctgattatcaataccttcatcctctgttccctcttttctcatgtaaatcctgaaactgtctacaggattccgtcaaggcgctccttcatcatgcgcagcgcattccctctgtgactaattctattcttcgtttcgctgtccagctctgctgtggaacagccatattcatccacataaaatataggatcatagccaaaaccatttgagcccttttcttcccagccgatatacccctcaatggtgcctctgaccaccagttcctgccgttcctctcccggtattaccgcagcgattgcacagacgaacctcgccgtacgttcttctttggggacaccgtcaagacggcttatcaaatttgcattctttatgcggtaggaagtatcctcccccatgtatctggcggaataaatccccggctccccgcccagataatcaatctccaggccggaatcatctgcaaggactatatctccttcacaggcgctttctgccacagctctggccttaatcagcgcgttttcctcaaaagtgcttccatcctccacgatatccgcatctattcccgcttccttcatggacagcacctgcagatccggattatcaagaatcatgcgtatttcccgcatcttcccttcgttgcctgtagcaaaaataactctcctgctcatttatcctgtgctccatctttcctgttttatctgtcctgcttctgccgcttaggcggtttaggacccaaatactgataaaaataggtcttcatcataccattatatatttttctgttcttgtccgcttttctcccgatgtcacgctccgcattctcatacgccgtaatcagatacatggaccaggaatccaggccgacaaaccgttccccgatctccctgtacaaagcgggcagcgcctctttttcctcaagccgctctccgtaaggaggattggtaataagaaatccatatttcttaggatgcctcagttcagacaaaggacgcctctggaaatgaatcagcttttccactcccgcaagacgcgcattttcccgtgaaacagcaaccattttttcatcgatgtcatatccctgaatgtctgtatccacattcagatccaccatttcacccgcttcatccacagcatcataccagtttctcctgcccaccacttccgtccaggattccgccgtaaagctccggttcatgcccggagccatattagccgccatcatagccgcttctataggaaaagttccgcttccgcagaagggatccaccagtatccggtcacctctccacggagtgagcataatcagggatgccgccagattttcagcgataggagcctttgccgtcagcttacggtagcctctcttatgaagggattcccctgtggtatccagccccacagtcacctcatccttcatcagaaacaccctgacaggaaaagacgcgccgttttcctcaaaccagcccacacgataaatccccttcagacgttcaaccatcgcctttttcataacagactggatatccgaaggactgaacagcttactcttcacactggccgccttggcaacccagaacttcccgtccgccggaataaactcctcccacgcaagactccttgtcccctggaaaagctcttcaaaggtttccgcatggaaactccccactttaataaggatacgctccgcgctccgcaggaacacattcgccctgctcaccgcttcctcatccccgaaaaaagtaatccgcccgtcttccacctgaatcacatcataacccaggtcaataatctctttttttaatactgcctccagcccaaaatggcacggagcaatcaactcaaattttctcataaatatatattacgtttatttcttttccccgtcaatgaaattttgattctttccccggacagtccgccatcccctccctcctccggttccgcatctgccgccgcgaatggccttccctctccgcccggaggtttttctttcctgcaggggcggcggtggatgtgttttctgacccattggaaaaaacggtgatgtttcttaatgttccgttctgccgggaggctgccgcccttagcggcttgtctgacgagccagaatcaacttaccgttttatcaaaccttaccagcgaggagttttgccgcgttggcagaatcccggcagaacggaacatttagaaacaccccgtttttgaggctggagcagaaaacacatccacttccgccccggcgggtaagaaaagcctccgggcggagagggaaggccattcacggcggcagatgcggaaccggatgagggaggggatggcggactgtccggggaaagaatcaaaacttcactgacccacgtaaaaagccgggaagggcggataaatccgctgcttcccggctctttcagctattgtagattagtaattgttctctttgctgctgttgcttccgttatggcagtcagaggagctgttcttgctctggttctgattcttctggctgttgctgctggaattctcagacttattctgctggttctgcttttcgctgttctggctgttctgattgtaatcattcttagacataatataaaacctcctgattcatttttgttacaggagtagtatttgaaaaaacagcttttttatgcacacattttttattttttttgaaacagcctgataatatatactacaagcactacgggaatcagataaggcaggatagcccacatcagtgaaccgaccacactgataaccacaacgaacaccatgatgacgagaatagcaatcagccaacctggcatatgaacccgtttgacggttctgccgtttccctgtgaataggcctcttccctgtattcatcccggttttgggcgcctgacgccgccctgaactgtgtttcgttcgcctcacgggcataagcgtctccggcacgctccgccgcatctatcagagttcttgccagaattctgggatcgcccagctctgagaggactgccgcttcggaccttcctttcgcttcttccgaataaaagtagttttcataaaatttaagattatcttccacggatgcagccgccatattcccgttcagtgcacgccgcagagcttccaggaattctgtttttgtcatctgcttatctcctttatttacttcctattcgtatcataccccacagaaggccatattacaagaaaacggtttatgaaaaaatgattaaaaaagagtaaaaaagacctgtccggtacccaaaaaacataccggacagatctcttttttatgattttctattcctgtcttacccgattacagcagtcactttctgtgtgctgtcaggaacggtaatggaaacggttttgtcttcggctttagtaccaatcgttcctccgtctgcttttacattcccgcctatgccgtgaagcaccagggtaaggcccttcatgtcggcatctgccgtaaaggatatggtatccgcatttctgcaggcagtcacgtttgcgacggtaccgcccttctggtctaccagacggcaggtacaggaagcgccgtccgcaagctcatacagatgaagggcagctccatctgcgtaatcataatccggcctgtcgttcactgcgccaagggcaaggagcgtattttccctgacatagaggggcagtgagaagtaatcaaactctccctcgtagtaacggccgccttcctttatttcaccggtgaagaaatcggtccatcttccttccggaagataatactgcgcttttttatccgctctgagcacgggtgcagcaagcagggcatcgcccagcatatactgggtttccagatatgccgcgaccggatcggaaggatattcaaataccatgggacgcatcatgggggttccttcttcatgtgcttccacggcctttgaatacaggtaaggcatcatggagcatttcagcctggagaagaaacggactacatcgctggcctcatcatcaaataaccacggcactctgtagcttgatgaaccatgcagtctgctgtgggaggaaagcaggccgaaggccgcccatctcttatacagatccgggcttgccgtgctttcgaagccggatatgtcatggctccagaaggagaagcctgacatggcgaaggaaaggccgccgcggatggtttccgccatggaaggataatttgcggagcagtcgccgccccagtgaaccgggaactgctgtccgcccgcacaggcgcttctggcaaagagaacggcatctccttcgcctcttgtttccttcaggaggttaaatacgcactggttataaaggtaggtatagtagttgtgcatgcttccctggtcacttccgtcaaaccattccacatccacgggaactctctcgccgaagtcggtcttgaagcagtcaactcccatatccagcagagtcttcagcttgtcggaataccatttgcaggctgcgggattggtaaaatccaccaggcccattccggcctgccagttatcggtctgccatacccctctgccgtcggctctctttaccagatagccgttctccgcgccttccttaaagaaaggggttccctgggcaatataaggattgatccagacacagatcttcagtcctttgtcatggtatctcttcagcattccttccgtatccgggaatactctcttgtcccatgtaaaatcacaccactggaattccttcatccagaagcagtcaaaatgaaatacgctcaaggggatatccctgtcggccattccctggataaaggagcttgttgtctcctcatcgtaattcgtggtaaaggaggtggaaagccagagtccgaagctccatgcgggaggaagggccggacgcccggtataagccgtataggatttcaggatttccttgggggtgggtccgtaaataaagcagtaacgcagttcttcgccgggtacggagaagccaacgtattccactttttcactcgccacttcaaaggaaacgttgtcggtatgatcgacgtagactccatagcctttatttgtcatatagaaaggaacgctcttataggcaacctgggaagcggtaccgccgtcttcattccaggtatccacaacctgtccgtttttcacgaaagaggtgaatctttcaccgaaaccgtatacgttttctcctacctgcagggaaagttcatttaccatataaggttttccgttttctgtcaggtaattctccgccgggaacatggtggaaggcgttctgtcccagcgggcatagcccaggttatggaagccgcatctggtaagctcttttccttccgcttcaaaataatagccccattccttcaggctgacatgcacggaaacctttcccgccttcataacggcttcttcttccccgatttccacactgacctcctgcatctgcggatgcttggggcacacgggttccttcttatcatagccttcatggtgccatgatctcactgaaatcatattttccacgggggaggtaaattccagggtgatggtgggcatattgagtgtcgcacctctggagctgatggttcccacgggagccagcactctcattcctcccggaatctcctgcacctcataagcctgggatgcatacaaaatattagccttttcactgcgcagccaatatccttccgtaaatttcatcttgttttcctctctttcttaagcttaagctaaacttatccttattcaatattccctactgacccgccttcgtaaacctctccctctacgactatgatttcggggacgctggttttcggcctctcaatctgtccgatcagcttttgtgcggcaaagcttcccagctttacggtatcctgctttaaagtggtgagctttggttccacatgccgacctatcctcaggccgtcataaccagcgatggaaatgtcctccggtatgcgaagccctttttccctcagcatattcattccccccagacaggaaaagtcatccgggtacagaatgcaggtgggcggacagggcagcttcagcagctcctccgtagcggcggcggccgcatccgtgtcgcggtatccggcctcaagcacatattcatccgggatatccagccccagctcctccgccgtcttataaaaagaagaaagcctgctgccggttacggatgacgcatgcccatggatataggcaatccgcctgtgtcccctgctgtaaataaactgaagcaatgattccatgccctttacattatcggacattacggcgatgcggttattgaaaatatgatcgatagtcaccaccggtatgtcgcttgccaccagctgggccacctccggatcctcaaaatccacacaggcaatgaccacgccgtcaaacccccggtatctggcatgctccagataggtcatctgcctgcgccgttccttgttccggttgacaaaggtgatatcataatcattcctttccgccgtttctttaaagctttccaatacgcctgcaaaatagtcgtgggtcaggccgctgtttgcttcatcaacaaacaggactcccaggttgtagcttcggttggtcttcagggtcctggctacggaattaggaaaataacccatttccttcgccgtccggcggattaactgcctggtttcttcccctatatcggtatggttattcagcgccttgcttacggatgccacggagactccgcatgcctgggcgatatccttcatagaaaccatctgcttccaactccttccgccgtttatatcttaatcgttttcgcccttctatcatatatcatatttacataaaaattcaatagaaagattcccttttcctgcagcatagccagttttcgttattttcccatattattcaccgtcatttctatgcaaattgtccacagtctataacatcggtacagataccgtatactgtgcaccggtttttttgtgattatttttccttttttcctcttgaaaaacacggagtttttctatataatccaagtcataggcagtttttaagcttttacttaatcgtttacgtaaatgaattgtcactcgtgtcgcctgcaggggaaaatgcaggcaggaagagcttccccggaatgccttcccatttaagaaaacagcgtccgccaggcggacagaaaggtgttcgtatgaaatatggtttttttgatgatcaacgctgcgaatatgtgatcaccacacccgaaacgccccttccctggattaattatctgggctgcaaggacttttttaccctgatttccaatacctgcggaggttattccttctataaggatgccaagcttctccgcctgacccgctatcgttacaacaatgttccttatgacaataacggacagtatttctatattaaggatggttccagcatatggaaccccggctggcagccttcccagaccaggcttgattcttacgaatgccgtcatggcctcggttacagcagatttaccggctctctgaatcaggcaaaggcggaggtgctcaccttcgttcccttaaacgatacctgccaggtaaccagcctgaccctgaccaatgaaagcggcgaaaccaaaaatctttctctgttctcttacgtggaatggtgtctgtggaatgcggatgatgatatgaagaacttccagcgtaacttaagcaccggcgagctggaaatagagggttccaccatttatcacaaaacagaatacagagagcgccggaaccactatgccctttattccgtaaacactcctgtagacggttttgataccagcagggatgcgttcctgggcacctacggaagcccggcggcccccgttgtggtaaaggaaggaaaagcttccaattccgaagcacatggctggtctcccattgcttcccaccagattaatgtttccctggctcccggtgaaagccgttcttatatctttgttttgggttatgtggaaaatgaagaggaagagaaatgggaggctcccggaatcatcaacaagaccaaagcccatcagctgctttcccgctatcagtccgatgaagctgtggaaaaggctttcacagaattaacggattactggcaggaactgctttccggctatcaggtttcttccgattgtgaagaagtaaaccgtatggtaaatatctggaaccagtatcagtgtatggttacctttaacatgtcccgcagcgcttcctattatgaatccggtatcggcagaggaatgggcttccgggattcctgccaggatcttctcggcttcgtgcacctgattccggaaagggcgagggaacgtatcctggatattgcctccgcacagtttggtgacggcagcacctaccaccagtatcagcctcttaccaaaaaaggaaatgcggatatcggcggcggcttcaacgacgatcctctgtggctgattgcaggtacaagcgcttatatcaaagaaaccggtgatacctccattctttccgaagtggttacttttgatgacggcggagaaggaaccctgtttgagcatctgacccgttcctttgaatttaccgttacgcacaaaggccctcacggtcttcctctcatcggacgtgcggactggaatgactgcctgaacttaaactgcttctccgcacagcccggcgaatccttccagaccttcggccccagtgaaggccctgttgcggaatccgttttcatcggcggcatgtttgtaaaatacggtgaggaatatgcacagctggctgagcttcagggacttacggatattgcggaatccgcccgcagggaggtttcctccatgtatgacactcttctggatgcaggctgggacggcgactggttcctgcgcgcttatgacgcttacagccagaaggttggctcctccgaatgcgaagaaggccagatcttcatcgagccccagggcttctgcgtgctggcgggagtcggcatcaaggaagggaaggcacagcgtgccctggacagcgtaaaagaacggcttgataccaaatacggcatcatgctccttcagccggcctatacccgttatcacctggagcttggggaaatcacctcctacccgccgggatacaaggaaaatgcaggcattttctgtcataacaatccctggatttccatcgcggaggcggttatcggcagaggggaaagagcctttgaagtatacaggaaaacctgtcctgctttcctgcaggatatcagcgaaatccacagaaccgagccttactgctattcccagatgatcgccggcagggatgccgccacgcacggggaagcaaagaacagctggctcacaggaaccgctgcctggaccttcgtgaatatttcccagtatattctgggaatccagccgagcctcacagggctgtgcattgacccctgtgttcccggggacttcggtgatttcaccatcaccagacggttccgcggagcggtttaccacattgaggtaaagaaccctaatcatttggaaaagggtgtttcctctcttctggtagacggggaaaaggtagacggaaatgtggttccttttgtggaagggaagaaagaatatcatgtaaccgcggttatgggttaatttcttcggcatgcagttaccgaatcattcattataaaagcagaaccggcatatctgaaaaggtatgccggttccatttttatatctttacttttatatctttacttttatatttttactcttatttctctattcctttacatccgccattaatgctgtacatcctgggaaagcagcgccatcaggtcaaaaggaggaaggatctcttccagatatgccagaagctcatcatcatagtcactgcgtacctcgcataccctgtcatacaccatggtaggttcctgttccggcgtaaccggctgccattcgtccgatccttccggattgggatttccatgacgtgcgaactgcatagccgctccgaagattttttcttccagttcatcggaaacacccggaatattgcagatttccaccttatccgtgttgtggaaaataaacggaatatcggaacaatgccaggctaccttgccattctgatacgggaaatccagggaaaacaggtagagataggccggtgcctttcctcctttggcatgaagctgcgcaagcgccttggagggctggcggaatatacgatccagcgcaagtacgtcaaccggctttttatccggatatgctttcaggaaaagctccttcaccttatctgcatgttcgccgtatgctccggcaagtatggctccggattcctcctccgtcagtttttccttattatatggagtgggcatgaaggaaaattccccgaatacagatcccaccataagcggaatggtttctgcatggtcacggaagcctgtgatcagcggttctcccagataataatcattgaccatcggcatgccgcctatgtatattccctgtgccgccaatgcaggggatacggtattataggcttttgcaagctcataataaggaacggtttccagcttctccacttctccttccggtatttccagctccttcagaagagctggaacaattttcgtgccgtctcccggtattatgggcataatcttgccgtccgatacaccgctcatgacaatggctttatggaacaggccgtccgcttccggtatctgcatcagccccgtaaccttcattccgccgccggactgtccgaacagcgtcacattctccggatccccgccgaattcttctatattgtcatgaatccaccgcagagccgccacaaggtcagccagccctgcgttaccggaattcctgtatttttccccgtaaggagagagatccagaaaaccgaggatattcagcctgtggtttacagacacaacaacgacatctccctgtactgccatattggaaccgtcataggccgcctgctcaatggaggaacccgccgcataaccgcctccgtgcagccataccataaccggttttttagcggttttttccagagccgtcgtccacacattcagattctggcagttttcatcctgaggccagtaacggtgagggaccagcagctctcccgtaggggtgtcctgggtcagaaggggacatacaaacccgtaagacgctgtttccttcaccccttcccatggctccacttcccggggcatctggaacctgcctgcctgtgcataggggatccctttgaagatatgcaccccgtcaaattcatacccctttacttttcccgcttttgtggaaactgcgggcacttcatcataattgaatacctttgccattcctgtttttctccttattctttcaaattttgcattataaagcttcctgtttcctgcagtgcatcccactatttcttctgttcacgctgattcagttcttccataaccttaggatatatcttatccagcttatagcaggcatacagtatcggaataataattacaaagggtatcggaacaatcagatacagaacctttatcgcttccagagcggcgggggcctggactgctgcaagtccgtcatagccggccgctcctatgactgccagcgctaccgcgcctcccactccggctccgactttggcgccgaacgtagtgctggaataaagcatgccttccactctggtccctgttttccagtgcccgtattcaatggtatccgctatcatggcgaacatggttcccgaaagggttgcggatccaataccttttattaccgcacagaacatgagccaggcggcggaagcgggatttaagagcatgagcagctgtcccgcaatactgacaaagctgccgtacagagccacatttcttttgccgaatttacggttcagcggagctgtcagaggcatgatgataagcacgggtacaattcccaaagcgccaaggaaaccggcaatattttcatttcccagaatatatttggcataataggttccgacactgccgctcatggacatgcccagcaccatgctcacccatatacccacaagcagaagccagtagttatttttaacgatcagcttaaaggaggtaaggaaaccaagctcgttatttttttctgcctgtaccctgactctttccttcgttttggcaaaacagagcaggaacagcgctgccgccactaccccgtacagaatggatacgataatccagcttctctgtttggtgcttcctcccatggcattcaccagcggaagcgtacatgcattgatgatcaaagagccggcctgcgccataaacatacggaagatattaataatcattctctgatcctgatccctgctcatgagagaagtaagagccccataggggatattaatcatcgtataaaggaaggttgttaccaggttgtaggtgattgctatatagatatactttcctgtaaccccgatattgggaaccaggaaaaccagtatggtggcaatccctatcggtatggacagccataacagccatgcccttgcctttccgtgtttggaatgggtcttatccatgatatatcccatgatgatatcggtaaaaccgtccgcgagtctggaaaacatcataattgcaccgacgatggccgcattcaggcccagtgcatccgtataaaaaaaggttacaaaggttccggttaaaaccagaacgaaattactggcaagatcgcctcctccataagcaattttttcaaatgtgcttattttttccacaaaatttttctgtccgtttaccgctgctttttccgacatagtgttccccctgtttcattatataatatgtacacgattattgccaacacattccctttcagaggcaataacctactgctcttttattatacggaacatatgttattcaaaatacacagcctttttccaatctatggatttttcttgaccactttgcccatgacttttccccttcattatccaatgacaagaatttggtataaaaaagacaagaacctgatatccttgcccggttaccagattcctgtccttttatatagatatggtaataagacaaacctcatggggcattagactggccttgattttcaggagcccttcggcttccgcctcctcccttctgtaaacagggctggaaagccgcatcaatgttttttcctcttccttagtcatcggttccggcgctcccatgtcaatccaggcatcgtaagcgctgccgccctttctgccgattccatatcttctgacctcgtgccttcccggacggactccctctaattgaatatggaaggaacggggcgctttctcctggaataccttatacctccgggtctttgtcagattcgtggtgttacggtaccggtaaagcatatcataatgacagtaattatgaagaaaaatctgaatctcatcttccgatgccgtaatgaaatagccgcttcccttcgctatcagtttatcccccgcccggctcagcagctgcatggcgcgataggcgctcttagctatcccattctgtgtaaacaggccgaagcctccatgaaaagcctctgccgccggtgcgatttcgtccagctgatcgctgatactgaaatatccaagaccgtaatagctgtcatggttttccatgatgcttttaaaaagatatgccgacttataacaggtatcgttgcacaaatccctctgccagatattattgctccactcatccatcaaaacaggcaggccgcagaatccttctccttctgcttccagaaaatcctttaccttccgccgcagatgcatcagacaatcttcatccccgtctaccgccatataaaaggattcattgttctccaccagctttaaaccgctcttctcttcctccggatcaatagccgcataggatcttaccgtaaatatatccggtatacagtctctctccctgcacaaatcgcaaaaccattctgctgcctccagagacagaagtgtggttcccggaccgcagatgacaaactctctgcaggcctttttaatttcctgataggttaccgaataaatctctccgaaatcttctttgacaaaaagcccgaaaagatgcatgtccatggaaatccatgggacaaacagccatttcttcaattcctccataccatagcgtccgatcagatgctccataaggctctcaataagcaggcgccactgctccaattccgctggaggcgagataaatgacggccttttaaaaaactgtacctttttttgcgccatagccgacggcatatgccccagctccagcatgggtttcgctcccgcggacaaaatgaagtccagggcctgatccagataaacataattaaaggaactgtttccattaacgtcccggctgtacagcatcatatcatcatccacaacacccttgcaccggatgtaccgaaagcctatcgatttctggatctccatgatttgattctgcatggatgcatttagaagatcccttgcataaccggcattaatcatggtcttccaggtatgccgcagctgtcgcttaacgattcccgtgttgacagatatttcacagactcccgtgaccacaggctctgctgcttcttcggccttatccgcatatttcatcagggaaacgaatgccatggaaaagccttctgcggtcttcatttcctccgcattgtccataaccggccttttccccagattccgcctgtattgtccgggagtgattccccgatactgcttgaatgcgtctatcagggcgctggcgctggaaaaaccgctttcataggcgatttccgtaaccgtcccctctccctgtaaaagcagggcggcatgaaaaagccgtacctgtgtcagatatccggtaaaagaaactcccatatatttttgaaagcttcttgaaatgtatgacgtgctcaggtatgtctgagaggccaaatccgccagcgttatgccttcccggtaattcctgtggatgtattccactgcggcccgcagcctttccctcccggattccctccctgtattttcaccgttttcgctgaaataccggtataagtcatccgccagtgccatgacccggctccgcaggtgaatggatagctccgattcttttttataccatgcccggaaggccagagccagatccttcctgataatgtcaaacagctgctgcttctcttcctcatgcagaaatgatttgcagttcacattccggtcttctgtttccggactggccgctgccagaaaggagggagacagggaaagagaaattgccagcccgttttcttccagtacaacactgtgcatctgaaagctgttgataacaaaaatatcctcccgggaaatggcataggtcctgtcgccttcctccgtatgcagccagccgttccctctgagtacaaatattaccttaagctcctgcgaccaggctgccgcggtatctttatgcctgattacatcgaattcaaattccccatttatattccggcccatattcgttaacccctttttatttcattccgccgttccttattcgtcgtaatcttccatatacagataccctacctcgcagcctgtatattcaatataagaattccctgctgcctttccggccttgtctattaccttcttcagctgttcttcatccattccgccctttccgaagacactgtcaatttcttccttcacagtccgggaaacggctgcaaggaaagcgtcacgggcttttacggtaagcttgtcggcatccaggatatgataagtaaaggtgtaatatccttccgccatctgcaccaccatcttatctccgaatacatcctcttcccttgtgctgctgatctctacctcatattcaggatccacctgttttcttgcgtacagctccctttgccgggcatagtattcctcctgggaggcccggaccgttgtaagcagaaactctgcattttcgtccgtatcctccatattttctatcacattatcataggcatcatagaaatcctccttatcctcatcatagccggaaaatacggcattgattctgcggttgaattctgctatggacatatcttcatatcccgggaatttgagttccttcaggaccaaatcatactgcttggtccaatccgcttctttttcttccttttcctcatgccagtcctccgtatcctcttcgtcatacacatcgttccagtaataggacagttccctgccgccttcccataccacctgatcatccaggtttttcaaaagacggaccagttccgcatcagccgctttctccatggcatcttcatcctgaagggcttcctgggactgtttcttcaaaaaagcctgcatatcctcatccacgcttttcagaatgccgtcccgctgcgccaccgttaccgtctgctcatcagggatggtgtaatcaaaggaatagtccgcatagctgcctgtcagaaactccttgtccccaaatacatctccataggtctccagaaaagcttccccgctgtgccagggatttttctgtctctggcagatcccgtaatgcttccgctcacattcatcccatgtattggaaagtgtgccatatacgaagtccgccataggatccgtctctttcaaggagtagaaaatacgctggaacacttcctccgtcttatgaaaagcgtcttcatcttcccaatccatcaccatacggttgaattcatccacactcatattttcatagcctgcggcctgataggaacgaacctgttcataatcttcttccgtatatttatcggaacctctccaccatccatagcgtgatctgccggagttaaaggaaacacaattattttccgagcttcctccgtcttcctgtccgaccgcttcctctgtttgagaaaccgtctgtgcggttgtttccgcggctgaaccatcagatatcactgtctccggagccgcctcaccacccggtgtttttgcaccgcatgccgtcagtaaggccgccagcaggataaccccaggaagcattgccttggaggaaaagaatttttcctttttttcttttttcctcatgctcagtaatcctccctttcatagacttcaaaattatagacctcacatcctgtaaagctgattttgtcattggaaagcttttctcccgcagcctgcagcatttccttcatatcctcctgcgcggcggacttcacttcatctgcctccagcaaatcacgggccgtctgcatgactttctgaagaaaggcatccctttctcctacggtgaggttatcctgatccaggatacggtaagtaaactcataatccagccagatttgtccggcttccacactgtccccgaacacatcctctgtcgttattttttctgcggatgccgaaaagctgggatcctttctcttaccggaatatacctcctgtacacggctctggtattcttccatggaagccggtatggtattgcgcagataacccgcattcggatccgtttccggaatattggaaaccacagtatcatacagctcataaatgctgtcaccgccgtattcatcgtcttccattatccggtttatggtccggttgaattctgcaatggacatcccttcataggcctccggcttaaccatactcatcagctgatcatactgttcctgcgtataatcttcggaatagccttctttccaggaatcccatgcattccacacataatccatatcggcaggcagttccctcgatttgtcttctccgtcatcttggtcagccgtttcacccgcattttttaccggaagattttccagaagattctttctggcagcctctgactgcttctctattgccgaggtggcaaatatcaccacaacggcagctacaattaccagggcgcctattattccggcagccgtccgttttttcgctttcataatagcatctatccgttccttcagggcattcttgctgaagctggaggacagaggtgtcagatacgtgcgcttttcttccatttccagaagggccagtgcataggaggggcatgactgcattccatactgccgtatcaccgattcgtcacaggcaagctccagatcccggtttgacaggatatacataacccatacgagaggattgaaccaatggatacacagcatcgcggcgagcagccatttggtgagcgcatcaaaacggcggatatgggacatctcatgggccagaataaagcccgccgtctcttcctccttccagtccatgtctgcgggaagaaggataaccggccagaggatcccataggtcagaggtgattcgattctgtcggaataccgcacctgcaccggacggcgcagcctgtgctcctcgatccaggatttggcgaagggctgttccacaggcagagaagcggcgtaaacccggcgtcccctcagatgaaggatgaggaatataagagcgagcaaagcagctccccctatccagagcagcagccacggggacagcgaaggaacggaagcctcgcgggccacattccccgtcagaagcagtccggtgcgctgccagttacgtacaggcatgggaaaatctccccggcgtcttattgcggaatatacgcttatgggcgaaggaatgcgcatcggcagaatcagacagcagaacgcggctccccaaagcgccagaaaagcggtcttaggcagacggttcaccgccagcgccctcacaataatgattacccctatcataaccgcaccgcttaaactcatttcaagcaatgtttgcataataacctcgatttctgcagctatagcgccgctcatttccaatttttgatccgttccttcatccgcatgatctcttcctgtgaaagacgcttgcttcccagcagggatgccaccagcaaatctgccgatccgtcaaaattgcgctgtatcaggtcttccgtttcctgctcctgcacgctttccctgcttatcaggggatggcagataaagccgggatccctcctttccaccgcttctttttccacacatttgcggatgattgtgtaggtggtggtcttgctccagcctacttttttattcaggcgttctgcgatttcctttgcgctgagatcgccttcgtcccacaggcattccatgacccggcgttccgagtcgaataattttccggtcatatttgtttcctccgttttactccagtagaatataggttcattctactgcaataaaatggggttgtcaatagaattatttgaattggccgcgtaacagttccgtcccctcttcttacctggcccgcagcaccggccctgtttccctcccggccagctttgctgagcgtatgatgtcccctgcgcaggcacgttctcactctgccaaaaacgcagcggtactaggattgcaaaggacgcaatccaaggaccggcgtttttagaaggcctttgcaggggataccatacgcgccgcaaggctggccgggagggaaacagggccggtgctgcgggcgggtaagaagaggggacggaactgttactggggtgtgaaattatttatggtcaattcaaataggtgcatgtatttatgaagggctttgagtagaaggagcatttatttgtcttgctgggtcgaagagaaataaatgtggatatatgcatttttatatataatttaatgtagaattttatatttttattgaccaatacaaagattggtaatctcatacctagtataaattgctgattcatgacagtagggtgacatcttattggaatttctgttgatgatgcatcattttatatagcagttgggggcaacccaatcgataatgtaaggctcgtccgcttaattttacttgtctgtgttattgattaattgtataatgtttttgcagccataaaccccgttaggaggattaagacatgagtgagacgaaattttgccaaagctgcggtatgcctttagattccaaagatgtatgcggcacaaaccaggatggcagcattaatgaagaatattgtatttactgttacaaggatggggcttttgttgacgattgtacgatggatgagatgatcgaaggcagtgtaaggcacatgaaggaatccggtatgctgaaggaacagaacaaaacggaagaagaagcccgggaatttatgtacagcttctttcctgaattaaagagatggaaatagaaataaaaaacatcccgcaaggcagttttctgcttcgcgggatgttttttctttaattaccgtcttccatcgggctgtatgcaatcttcacattaatgtcctgattgtaattgccaaaggatttcccgaaaatcgtcagtccgcccacatgctcggaatcctcgtccacggcaaagcggagccgcagcgtgctcttatagtccagatgaagttggcggatatccatatcggaaatcttcaggccgtcgataaatgcgcctttggagttcaccaccaggagcttcagcattccgtattgattccatttggggggccaccagtccggtgtgaaaatacccttcacgtcgccgaaatcaccgggtgatgtccattttcccagcagtactccgttcagataaaaactgatgtcggagggccagacgtcattcactcccggggcttcgcttcccagctccagagatatggatatctggtctattttgcttccggaggggatgaaattggggatgatatattccacatatcctctggtaaaccagaggatatcggcattgtatctgtcgggatgcgcgaaatatctggtgtcgtccactgccccgatcaacgcggtggaggttgccatcccgcaggtcgggcagacttcatatgcggaataatgtcccaccttcaaatccgtgtcattaatatttttttctgtctcccggttatttacatcaatcagtattttgtccagagccacctcgcattttttctggtttccatgtcctgcggattcgctggtgacggtgatgatgccgcagtcttccagctttttaatgtggctggtcagcgcgccgttggttatcttaagccttgttgccagctcattcatattcatgtcctggttttccaggaggattttaatgatttcaattcggatttcggagcccagcgccttgaatacctcaagcccctcttccaatgattttatatacagcatgcttatctcccggatttctttctctgctgctgccgcaagtgctcctttttggaaaccgccgtatcttctttccgatttaccatttatcataaggacagccgttcacccggattacggcccgcagctccacaaagcagccgcaggccctgcacatgccttcctgcagcatatcacattgtttgcagacggcgagcctgtcttcatatagctcaccgtccgccttgatatcttcatccaggccggcaatgtaatcatgcaggttctgaaaataggcatccttatccatctctctgaggagacatttcaggcaatgcttttttccttctgcttccataatttccccgcccgtctttctcaattactgaacgcgaagcagtaccacgctggaagcggggatgcggaatttcaggcccttttcggtgagttcatatgcggtaaattccacttccttcacacactccggattttcaaaggtgttataggcatccatcttctgcgtgaggatgctggctgtcactttggacggtgccagttccgcaaagcttacctccacttcactgtcctctgtcacagacaggttattcagtgtcaggttcacggttccgtctgcagaaacggatacggattcatgcagggacggtacgcggaattcctccacgccgatttccttcaggccttccacgtagctttccacaagatcggcatcctgatggtatttgtacatatggaatacgtgataggtcggtgttttgatcattttagggccttccgtgaggataacggactgaagcacattcaccatctgtgcgatacaggccatctttactctgtcgcagtgcttattgaaaatattcagggtaattccggcaaccagggcgtcacgcatggtgttctgctgatacagaaatcccggattggtgcccggctccacatcaaaccagtctccccattcatccacgatcaggccgattttcttttccggatcatactgatccatgatcgccccatgtctgtttaccagttcttccatatacagggcttttcccatggttttgaaccaggtcttttcatcaaaccgggtagcgcttcctttctcatcccatccgtccggatgtacatagtaatgcagggaaaggccgttcatcaggcgggagggagtgggggcgcaggtttcaagcaccttgtttgtccagtcataatcagccacgttggggccgccgcataccttatagatcggggcatcctgatgatactggcgcacataggtctgatatctgcggtaaaggttggcataatattccggtgtcatattgccgccgcagccccagttttcatttcccacaccgaagaaatcgattttccagggtttctcatggccgttctgctttctcagatccgccatgggggaaacgccttcaaaggtgatgtattccacccattcggacatttcctgtaccgtgccgcttcccacatttccgtttacataggttttgcagcccagctgttcacagagttcaaagaattcgtgggttccgaagctgttgtcttccacaacgccgccccaatgggtattgatcatttttttcctgttttccttggggccaatgccgtccttccagtgatattcatccgcaaagcagccgcccggccagcgcagcacgggaatctgcatttccttcagcgcctccaccacatctgtcctcatgccgtttacgttggggatgtcggaattttcgcccacataaagcccttcatagatgcagcgtcccagatgctcgctgaaatgtccgtaaatttccggattaatgtgtcccgtttttttcttttcattgataaaaattttggccatttttttggtcctccctttatctgtttttattatccttaagacagcggctttgccgtctgcttctcttatctacctgtaggaaaaaacaggttttccatcttcgctccaccgtaccttcatcagcatcgtgtgccggttgggattgtacaggggatctccttcaatgacagcttcttttctggcatgatatacacagatatcgtttccttcctcatccgtggtaaaggagttatggccggggccgtaaatctccaggctttcctcggaagcgagcaccggcctgcgttccttggtccaggatgcgggatccagaagatccgcttcttccgatgcgctcagcattcccatgcagtagcaggccccggtggcgctggcggaataggtgagaaaaatccggccgttccttttgattacggcagggccttcattcacccagaaatccactctctcccagtcataatccggtgtggtgagcagtacctgcacggtttccaggcggttgggggaagccatgcgggcaatatacagattggaaatcattttccctacccccactttttccgcccacacataataacggcttcctttgttctcaaatacggtggcgtccagggaaaaggcgcggaaagaaaattcatcctcttcggcacactgcatcattcccagctccgtccacttcccggttatgggatcctcatccgcacattccagcacaaagggcctgatcgcccagatatcctccgcttctcctgcggcaaaataaagataccatttaccatccaggtaatgcagctccggcgcccagatgtgctcggacataatcccgcttttgtgctttgtccacacggtattttccacggctcccgccaggccggcaagactgtccgccctgcgcaggatgattctgtcataggcaggtacggatgcggtgaaataatagcagccgtccgtatgacggtatatgtaagggtccgccctctgcataatccatggttcgttccatttcagctgttctttcatttctctgctctcctgttttttattttcttttaaaagcaacggcttccgataagcttaaatgtttagatatttttaaaataattgactttatactaaattatataattgataatcgcatttggcaatatataaatttaaaaaaagcggccttgaaataaaatcaaagccgctgcggagtatccgccgatataaattggtttcatataaaaaataatgcattctgtctttcacatcctgatcgggaatcatcctccccgaaacagaaaaagcgctgccagcacaagaagaagcagcaccagcagggacagcagcatttccggccggaacggcctcgcgctgccctgatccctttccggttccagaagcattccccatggactgtagggatttataggccactgcagatatggattgttttccccgcccacagacgccagaaactggttccagtccctttccagctctcttttccctttttcccactcctgccctgcatcctccgccttcgtcaggccggaaaagaaaccggaagactgcctgcccttcctgcctgtacggctctccttattgttcccggagccgcagtattccccggcggcatatttcagccccttctccagtatttttcccggttcccgctcatccataaaaatccggataatatggtaatatatccgccgtacctttcccatatccgcagtctcccttaatgcggaggcctgcgctccatgcctgtcgctgcccggttccagataaaaattgatgagccgctggaacgcctgccggatatcctttcccatggatttccccactcccgcatactccgaataaacctgggccttcaccatgttttccgccagcaggaatccagccagttcttcgtttcccctgattgcgggcagccgctgatataaatcccctctgtttgtaaaataatccaggaatcgctgcgtccgttctatgtcggcgcctgaataatttttccccttaagctgtctgacatccgcatccgaatacaggggaatcgaaaaccgttcattcttccggatctgttcccgataccctttctccacatgaatctcccggccatcccttttcccgtaaagaactccttccgggaacgtcttttccatccgctgcgccgccttgtcctgctttccgcccatatcggcccgcatgaagcttccgccctgctgctccttatgaagcagtaccacattctggccggactgtttcaataacaaaaagggaaggatctcagccgcccctttttctccataacgggaaagaaatgataaaagcgcgggatatcttaccgcaccctcttttcccatgagctccagcagcagggaattcagcctttgcagaccggccgcctgctccctgccggaaagccccccgctgattttttccaaaagagcctgataaacagaggttatctgctccagctcctgttccagcccgacagacggacgtatctgccagtcctcaagagtctcccattccctgcgcatactctcttccagctgtttctgcagactttcctctgtctctccgtttttaccataacggagcgcttcccgggaaagctccgcctcatctgcacgctttccttccccggcaggctgccctccggaagccgcctgggcattcttctctttagaagccgtccccattttttccagcgcttcattcactgactctgcggaggcctttacaaaatttttcccgatggcttccaccgcctggcgctccaaatcagccgccttttcctggacggccgccgtacccgcgggcgttcgttctgttttttccgtaaaatttacagggataatttccatacaagcctcctgtcctcttctacctcttttatcggcaggattccctgtaaaataaacctgtttttacaatgctctcagctttttcatccggaaataatagctggtgaccaaaatcacatccgctcccgcccaggcaagtatctccgcataaaaaattccttcctcgcccagaagcaggggcagaagaatcgccgagccggtcctcatgatgaattccgcgatccccgaggccatgggaagaatggtatcccccatcccctgaagggcggaacgggtcacatgcagtacatacagaatgggcaggaacacactcataatcgccagataatgataagcgattcccagcgtcgccgtcacatcctccggcgctccggaaatgaaacagcccaggatcgcttttccgaaaagaagcatggccgcagcaatcacggcggaagtaaccatggcaacgatcagcgcggaacgcatccctttactgatccggtcaattttcttcgctcccagattctgccccacataggttaccatagcatagccgtaagaggtggccgccacctccagaatgccgtacagcttgttcgtagcggtaaatccggcgatgaaaaggactccgaaaccgtttaccacaaactggacaatcatgccgcccaccgcgatgatcgcattttggaaggccatgggaagccccagcttcatcagatacatacacagggagctgtccatccggaaatcctctttggaaaaggcgagcacctccactcgcaggatggcgaacagacagaaaagcccggaacaaaactgggcgataaccgtcgcgcctgccgctcccatgataccccagtgaaagcccagaacaaataccaaatccagaattacgttaataaccgcagcgaccaccatggcatacaacggtgttttcccgtcacccagcgcacgcagaatggaagccagtatattataagccattaccaccggaatccccgcaaacataatcctcagataagacagggaatcctctataatcaaatccggcgtctgcagaagctccagtatcggccgggcaaaaaactggctgaaaagaagcagcactgccgaagttaccaacgccagcaaaagagaattagccaccgttttacgaagccgcttatagtcaccggctccgaattcatgggacattttaatggaaaagccctgggtaaaaccctgaatcgtccccagaatcatccagttcagccagtccgccgccccaagcgccgccagcgcccccacgcccaaagcctgtcccaccaccatcgtatccacaacagtataaagctgctgaaagacattcccaatcatcagcggcaacgaaaaagccaagataagttttaacggttttccctccgtcatgttctgaatacgtgctgccatctattttccaacctttcttttttcgttcctattgtacggcatgaaccatcccggagcctttccggccctgcgtcccgcccgcgccctgcggctgccgttgtgtccgttccgacccgtggcctgcctgttatgtctgcgcaggtctttctgaaaaaatgggtgcctgttcttacagcatccgcgctttcggtttctgtctgccctgagcggcggtgtctgacgaacgaagtgaggagttcagccgcgggacagaaactgaaaacgcggatactgttagaacagccccatttttgaagcaagacctgcgcagacataaccggcagacagcgggacggaggacgggatggacacagacagccgcagggcgcgggcgggacgcagggccggaaaggctccgggatggttcatgccgtacaataggaaacctgcactgcctttacaaaggccgcatgcaagtttataatcacactatatcagaaaatttcagaaaacaaaaggggcggatttatggtacaggaaaatacggtaaatgatttttccaaaggaagtgtggtaaaaaatattcttacgctggcgctgcctatgacattggctcagctgatcaatatcctttataatattgtggacagaatgtatatcggccgcattccggatcatgccactctttcccttacaggcctgggtctttccatgcctattatttccgcagtcattgcctttgccaatctgttcggggtcggcggtgcgccgctctgctccatcgccaggggaaaaggcgatatcaaaggggccgaaaaggtggtaggcaatgcttttaccatgctgctgtgcaccggtgtcctgctcactgtcacagggcttctgtttaaaaagccccttctgtatgccttcggcgccagtgatgcaacctttccctttgccgacagctacctttccatttatctgctgggatgtaccttcgtaaccgtcagcctgggaatgaacagctatatcaatgcccagggctttgccaggatgggtatggtcaccactctcatcggcgccgtgctgaatatcattctggatcctcttttcattttcaccatgggtatgggaatccggggagccgccatcgccactgtcatatcccagctggcttccgccatatggaccgtgcactttctcaccagtccaaaggctatcctgcgcattcgtgtatcctgcatgcgcccgtgcctgaaaaccatccgggatatcgcggctctcggactttccaacttcatgatgtccattaccaacagcatcgtccaggttgtctgcaactccacgctctccctttacggcggcgatctgtatgttggcgtcatgacggtaatcaattccgtccgtgaaattgtctccatgcctgtttccggtataaccaacggttcacagcctgtcatcagctttaactatggcgcggaaaaatatgaccgtatcaaaaccgccatccgcttcatggcagtcagctgtatcgcctatactactgcaatctggggtatcctccatctgttccctgttttcttcatccatattttcaatacacaggctgatttggtggaggctgcggttccttccatgcagatatattacttcggcttttttatgatgtccctgcagttttccgggcagaccgtattccaggctcttgggaaagccaaatatgccatctttttttccattctcagaaaggttgtcatcgtggcccctcttaccatacttctcccccgctggatatccccttccgtaaacggtgtatttctcgcggagcccatatccaatttcatcgggggaaccgcctgcttcgttaccatgctggtcgttgtgggcaaggaattgaaggcggcccagaaaaagcaggatgttatggcagacgctaatatcaggtgctgatatacatataacattttttcaaattttcccaaacatctattgacatttatttatgtatcggttaaaatatagaacgttgccggagttaatccgtaacaaaatgtgcgcgtagctcagctggatagagcgtctgactacggatcagaaggccgggagttcgaatcttctcgcgcacgctgaatgagaatgctgcagagtggttaatttatcattttgcagtatttttttaataaattttattaaaataaggacatctggaagctctgttccattcccgcttccggatgtccttttcccttaatataatccgttgctgtacacatttgaagcattggatactgccatcagcaaatccaccgcttcaatgggatccgccgcatgaaaccggctggtaactgcatccaccatttccactccgggaatagacgccgacacaagagcgtaaccggaatatttataagtgatttccacatccagatccttcagagacaccggaggtacttcacggcagccttttaccatcttttcagccgcttcttttatcctgcgggcgctcacttcaggatgaaggcagtcggcgcagctccagttcacggctttctttgtgacagcatattcaatggccggattccactcctttacttcctcctgcaggcagtcatctccggaaaccagaatgacaggtactccgtaagctcccgccagagcggcgtttatggcaaattcccctgcgggccttccattatagctgatgttctggaaaacgccgccgcttatcgtatgggaaagcacgccgccggagccgctgcggctgtggtagccgataaatattgctccgtcaaagctggagtccaagccgcacatcatcatctgaggcttggggtagccggaaatcagccgggctgccggatgaatatcctcgatgcacaggttacgcatagtgccgtgggcatcatttaccacgatttcctccgcgcctgccagcagggctccctcaatcgccgcattcacatcaccggccatcagcttccttcctctttcgtattcctccgctcccggtgacaggaattttttatgggtaataccggatatgccttccatatccgcagaaatatatatcttcatatcaacttatcctccttgataaacatctattccttatcatagatcctgtgtccggtttcctttccgtccttccaggatatgtccacacattttctgcccttgatgcagagccctttcacatagccttccttaaactgtgcgggaagggccggaagcaaagtcacgctgccgcctctgtcctgtaccagcatgtttgcgattccggcagtcccgccgaagttgccgtctatctggaacgggggatgggcatcccacagattcggataggtggaacgggtgagcagtgtacgcagatactcataggccttttccccgtccttaagaaccgcaaacagattgatgatccacgcgcagctccagccggtatgcccgccgccgttttccaaccggtgcatgagggatacccggcaggcttccgtcagctttgcatcccctgcgaatacctccgccgggaacaggccatacagatgggaggcatggcggtggccaggctccggctcttcatattcttcatgccattccagaagctgtccgaagcttcctgtgcggaaaggcgcaaggcagggcattttctcacagatttcccggtaaagctcatcctgcgcgccgaggatttcacagattctgcagtaatgggtgaacacctctttcacaatagccatatccatggcagaagcataggtaaggccggtaatctgcccatccggaagacggaactggttttccggtgaggtggaagggcaagtcacccattccccctggtattccaccagccagtcgttgaggaacagcgctgcttcccggataatgggggcggctgtatttttcagatattcttcatccccgctgtactcataggcccggaaaatctcctgtgtcagccaggcgcctcccataggccagaaggcccagttcacacagccgtcttcccctgctttttctccctgaggcacacctacgggacttgtattgccccaataatccacattatggtgggcaacgcttcctctgcagcgataattgaccgcagccgttttctttccttcctcgctgaccctttccacaaaccggatataaggttccaggcattcctccaggttacagcttaacgcatgccagtaattcatctgggtattgatattgatggtccagttgctgctccagggcgcgcgtagctcccagctccagatcccctgaaggttggcaggaaggctcccttcccgtgaggaagcgatgagcaaatatcttccgtactggaaaaagagtccgtaaagtccgttatcctcttcgccctttttcaaaagctccagccgttcctccgtaggaaggtctttctgttcgcccaggtacagctccactttatcgtaaatgctgcgataatcctggatatgcgccgctttcagggcttcgtaatccatattgtcaggaagcacaggcggcctcatggcagagagcatcagcaggcagcgggatgcgccgctgacatggagcatttcctcctcttccctgacttgcccgtcacaggaaaccacccggaattctgcattcacctgcattccctttgttccctggacaacggagccttccctctccggaagataggaaggatccacatgctccggacaacggcccgtgacctgcagcgccccgtcctccgcactgacagcgaggcaaagctgagatataaaggaaaccgtaaaatccataaccggtttatccgcagtgagcaggacaaatatagcttttgcaggataacttgcaaaatactcccgctgataatgcacttcattgcaggtataggaaacctgtgccactgcgttttccagatccagctgtctccggtatccttccgctttcccttctttgccaattccatatgcaaacttcagtttcagatttcccagaggaaggtaggattcattgtattcccccagcatattgttctgtatcagccgctccgcctctttattctttccggaaaaaacaagacttcttacttcttccagacagtcggccgccttcgcattattcttatccttataatagccggaccacacactctcttcgttcaggccaaggatttcttcctccgcaccgcccagaatcatcgcccccaggcttccgttcccgatgggcaggctctcttcccagcgttccgcacttttttcataccaaagcatcatttccttcatctcttttcctctcttccctgcgctgttttttcagacacgcagaatatccatcagctcttccttcgtaaaggacgccattcccatttcttctcctcccaggattttatctgccagttccttctttttctcctgaagagacactatcttttcttcaatcgtccctttggcaatcagcttgtacactgtcaccacgttctgctgcccaatccggtgcgcccgatcggtcgcctgattctgaaccgccacattccaccaggggtcaaaatggatgacgatatccgccgccgtcagattcagcccggttccccccgccttcagggaaatacagaacacctgggtttcatctttattaaagctttccaccagttccagcctcttcagcttcggcgtgcttccatccagggcataaaagcttatatcctctttcaccagttcctgcttcagccgttccagcatggatgtaaactgggaaaaaagcaaaaccttatgtccgccctccgccgcattgcgtatcagctccaggcaaagctgcattttagcagagccccctgcatatccttcaaaaagcaggccgggatcacagcaaatctgccgcagcttggtaagctccgccagtacctggatctgcttaccggcaaattcctgttctgtctgtttggagaggacagccagaagccgctggacatgcgcatcataaaggctgctctgttcgtcctccaggacggccaccatatttttctcgattttatccggcagatcggtgagcacatcctttttcagccttcgtaaaacaaagggacgtatcatccggtgaagccgctccgccgcttcctcatccccgccggtcacaaccggggtttccagctcctcacggaaacgcccgtaggcaaaaaggaagcccggcatcaggaagtcaaaaatactccacagctcactgagacggttttccaccggcgtgccggtgagggcaaggcggaaacctgcggacacctgtttcaccgccctggatgcctgtgtggaatggttctttataaattgggcttcatcgattacctcacaggcaaagctcattttttcataaaggaggatatccctgcgcagaaggtcataggaggtgatcaccactccctttccctgtgcttccacacgcttcagcagctcttccctttccttcacatttccggcagccgtataaacaggaagcgccggggcaaatcgttccagctcgcttttccagttataaaccagtgacgccggacagacaatcagccagggccttcccggattttccccgctctccttccattccgacaggagaaaagcgatgacctgcagagtctttcccaggcccatatcatccgccaggatgcctccgaagccgttggccttcagcgtttttatccataaaaatccctgtttctgatatccccgcagaatattgtccagttcgctggggatttcaaaatcattgtcctccaccgttttcatattccggacaagggaacggaagctcttgtttttctgaagggccaggccgctgttttccttcaggctgctgtccagatacatggcacggtaacgggggatttccgcctttccgtccttcagggacgcatcggtaatctgaagctcctgcttcagcctgcccagcgtgcggattccctcgtcgctcaaatccacgaagctgccgtttttcagccggtagtacttcttgcgcctgtcgtacctggacaggatatcaaccagctgatccaccggcatctcctccgactgcagcgtgagctccagcagctccccttccagggaaacgcccaccgacacatggggcgcgggcagtatcttcatatttctgacagaatccgatatatatacgtcacacagctcctgaagcctgggaatgccttcctgaagaaaggtaaaaagccgctcctcatttttctggatcaccatctgatgcttttcgggatcataagcgtcaaaaaaagcactcaccagccccgccattttcatttccctgtgcgcatcccgcctgtccgccaaattaaaattttcatagagattatgcttttcttccccatagaccgagtataactcgcaggtaagcagatccctctggggcgcatccaggtaaatttcaaatacagcctcctccggcagatattcctccggtataaagttctgcattttcacctcaaaatgctcctgcagcaccggaagcatgtcccttgtaaaggccgggagctcgtccgccgacacataaagcccgttctttccgaagctttccatgtaaagaaggaactcgcgcacctcctctatccgttctctgtccgttttccagacaatcccgtcatcaaaaaagtaaccgtacctgtttccggtaacaaactgcatacgctgcagctttatggaaatccctgtcttatctccattgatttccagaagccgctccggctccccttcccggatttcccattcccggctgctttcctcatccactgctccaaaaagcggggctgcctgtgccgcctccaggaattcatccgcctgatcccctgctatattcagttccctcttatataccgtggacaaataatttcccagatagctgcttcctttcagaagcgtaaactgcaggaaccgcaccatgggcctgctctccggtgcaaaggcctccggatgatggtagaattccagctccctgccatagcttacacgctcattccttgccaccgcattcacgaaatcccctatatttttcagcacatacatccgggtgttcccaatccggaattccgccttcatgcttcccccggtcagcttgaaatgaggctccagacggaccttccccaggatttcctgctgcatcaggtttaccttatccttcatcacgtactgccccaggatcccatcgaagccataggtggaggtacgcacggagggcgctgccgctctgctcacaggcaggatccgggacgcggccttacctgttctgcgctcctccagataagtgagcagcaccgccgcacaatgcttgcaaagcccggcataggtataaaaagcggggcactcgcactcatattccaggatttcccggtagtcttcatctattttaatctttacttcataaagatttccacgactgccgttcacattggcctccatggaaatcacctcgaagccgtcttcttttccctttgtccactgcagattgcgcacggagcccctccggctcaattcctctcccttttcaaaggtcgtcttatggcattcccgacggatatctgtccgactcagcataatctcggtttcctccgctgttttcatgttttccctgactggtcccgctactgtaagaaccggatttatcataccattttctgaaggaaatatccatcctgtaaaaccaaaggttgaggttacggccggatccctatataattggggtgagaacaaaaaaacgcggatctgctgccgaaagcagcaaaaaggagatagttcaggcatggacggcagaatactacttgtagatgatgaaaaagatatcgtggatcttttggaaaatgtcctgacagaggaaggcttttctttgattcaaaaagcgtataccggtaccgaagccataaggctgtgcagggaatataatcccgacatcgtcattctggatatcatgctcccggacctggacggcctggaggtatgccgaaagatacgggaattctcttactgctccatcctgttcctttcctcccgaaacgacgatattgataaaatactgggcctggcctgcggaggagatgattatatcaccaagcccttcagcccccgtgagatggtgtaccgcgtcaaggcgcagctgaggcgtcagcagtatcagaatgcggctttgtcccatgccggaggactgctgaccgcaggccctctcaccctggatgaggaaagctgccgggcctataaggacgggcgggagctcagcctgaccggccgggaattcctgctgctcgcctgtcttatggaaaatgcggaccggattctctccaaagaaaggctttacgaacatgtatggggggaatacagcagcatctgtgacaataccataatggtccatatccggcatctgagggaaaagctggaggataacccttccgttccccgtcagctgatcacggtaaagggcctgggctataaattaaagaaaaaggtggactaatctgcatgaaaagctccggttaccgttccattttccatatttacctgatttttttcctttcccttttcggcgccctgacggcggcagtcattctttccttcctccttttttccctgcaaaagccggatggctctcttgtaagaagcgactggcccagaaagttcacggaacaattcggggaacagattgtttttacagacgggaagccgctgctgctccagtcgggaatggaattattgcaggaggaaggaatcggattccagatcctggatgcttcgggccgggagatttacagcttccaaaagccggaatatgctcccggcgtctattctgctccggatctgctgcttcttttctcagaaggacagacgcaggacggacaggggatttgttttgcctccccattgtcaggtgactattgctgccttctctattttcccataaaggtatccagggccaccatgtatctgaacggacagcgttttaccggcgggaaaacagttattctggctgcggctgccattctctttctcatcatccttttttccggccttgcctatggcgtattcaccacgcggagcatgaaccggctgatcacctctatccgggaaatcgccgcccgcagctatctgcccgtcagcggaggcggcgtcttccgtgatctctacgacagcatgaaccggctggacagggaaatccgcaccagcgaccggctgagggaacagaccgaaaggatgcaggaagaatggatcgccaacatcacccatgacctgaaaactcccctgtcccccatccggggctatgcggagctcatgcaggagcccgattccgccaagcaggagcaatacggccattatgcgcggattatcctgaaaaacacgtcctacatggaagcgctcatcgatgacctgaagctgacttatcagctgaagaacggaatgatccccatgaaaaaagaggagcagaaccttgtccgttttctcagggagcttgtcattgatatcttgaatacccccgaatatgaacaacgccggattctctttacctgcacccgggaaaccatccttttttccttcgatcccactctcctgacgcgtgctttccggaaccttatcctgaatgcctttctccatggggaatcggataccgaggccgccctgcatatctgccaggaggggactgtgattcagataaccgtctccgacaacggaaaaggaatccctgaaaaggatcaggaaaatctcttccgccgctattaccggggaaccggaacggatgagaaaacggagggaaccggcctggggcttgccattgtaaaaaatatcgtttccctgcacaaaggtaccatctccgtttccagtattcccggaacgggaacggcctttcatatacgctttcccctgtcttaaggttaattaaggttgcctgaaaatccggttaaggttggcagtttatcatgtctctatgataactgacaaccttttttgtgtatctttaggaggtgcaaccttgaatattgtcctgaaatacattctcaccaatttaaaagaacggaaactgcggacagcagtcatgctgctttccatactcttgtcctccatgcttctgttcgtttccttttccatcggtgaatcctatgaaagcgcacagcagaaaatggccagagggatggccggaagcgccacacttgctgtttcatccgctgacggcacaggcctggttccggccgatgccatccccgcccttccctccatccgggcaagcgcaggggttctggaggcgtccgccctttataaggaaaatggttattatgaaaccattgatctggtagccgccccattgtcccagttgaatcagatcaatccgccccgcttaaaaaacggcggagaactttccggtttttccggcagcaggatcctcttacccgatcggtttacctccaaatacgggatagaaaagggggataccatcaccctgcagataaagggaaatccgataagctttgaagtggcggatattgcgtcctacgatacggttttcctgcgtcacacaagaggagcgaccgcccttcttcctctggaaaccctttccggactattgggagaaggggaaggcttcagccggattttgctggaaccggctgacggcgtttccgcagccagcctgaagcaggagctggaagccgctctgccggacggagcataccacgtgacggaaatcgtggatgaagcccgtatcgctgcggatgcaagacagaaatccatgccctttttcctgatcagctttttctcgctgaccatgagtgttttcatcatattcagcagctacaaggtcatcaccctggataggatgcctgtcatcggcaccttccgcagcatcggcgcaacccggaaaaccgtttcccgtattctactgctggaaagcctcctgtatggctgcgcaggcggactgctgggtataccgcccggaatcctggtactgtatttcctccttcagggcatggggaaaaacctgtcccagggaatggaaattcccatagtcatctctgtatacggccttttcagttcctttgccgtcgcggtaaccgtctcccttctcagcgcctggattcctgtacacagggccagccgcctgccggtaaaggaagtggttctcgggaatgtggaagaagaaccggtttcccgccccctcgtcctgattacaggcgccgccctgttttttctgtccgtcatccttcccaaagccgctccggagaacctgctttatccggcaggcgccctttccctgctcggacttctctgcgcggcgatcatgctcattccgctgctgaccaacgcggcgtcacgcagcctggaattcctttatggcttctttcccggcaatgaatgcagactggccgccaggaacatgcgtgacaacaagaatgtcacccagaatgtcaccctcctgttcatcagcatatctgccgtcatcgtcatccgtgtggtgggaagctttgtgaccacctatgtgagcgatgttttcaacggcgcagaactggaaggcttcgcggacggaatgatggatcaggcctttgtcgatgaggtgaaggcaatggacggcgtggaaaaggtactccctctctatgtctttaacggaaagctgcaggggaacggcattcctttttcccgtctggaggccacttccaatctggaatggtataacaccatgttcgccctccattacaccgggcaggaagaaaaagaacaggccgaagcagcttttggttccagccgggcgattatcctgagtgaagacaggatgaagcaggccggcttatccccgggcgataccatccgtttatccgacggcgcttcggaagaggaatacaccgtggcaggaagctttaaatcaagggctaccgacgtggaggcggtgattccctccgactgtgcagtaaccgatttcagcccctcctcctatggtttcctggcttataccgccgccgacccggaggcagtcatgatccagatccgggatctgttcgcagatactcccaactggagccgtacggtggaagaatttaatacggacgccctttctaccgtaggcgctttccttcagcccatgcacagcatgacctactttatcttactcctggccgccataggagtaatcaacaaccttctgattaactatatgcagaaacggcggagtatcgccatgtataagtccgtgggcttaagctgccgtcaaaacaggaaaatgaccctgaccgaaggcttctcctccggtctgctgggggctttgatagccatgtttgtttcctaccaggaaatacaaacgatctttctggtggccggcccgaaaatatccatggttcccagactggaggcctcttccttcctgaccgccggtatgctcggaatcctggtaaccctgctcggttctgtcgtccctatctggaaaagccgcaggatgaatctgatcgaagaaataaaatttgaataagaaagcgaaggtctggtatatgaaagcattggaaaaaaacatcgccatagaaggcaggcatctcgtcaaaaatttcaatcccggcggggctgccacgaaggtactcaaagatgtatctctgcagatagcacagggggaattcgcctccatcatgggcccgtccggttccgggaaaagcacgctcctctatatcctgggcggcctggatacccccacatcaggatccgtcctgctcaacggtaccgatatttcccggtttgacgacgagaaaatgagccggatccggcgtcagaaaatcggatttgtttttcagttttataatctgatacccaatctgagcgtggaagaaaatatcctgctccccctgctgcttgacggcaggaaaaaacaggattataaaagcgacttggaatatatcctggaggttgtgggactctcccaccgccgcaggcatacgccccgggaattgtccggcggccaacagcagcgggtggctatcgccagggccctaatcagcagaccggaaatcctctttgccgatgaaccaaccggcaacctggatacaaagaccggagaggaaattatggctcttttacaggagatcaaccaaaccaacgggcagaccatccttatggtcacccattctcctgaagccgccaaaagcagcagccggattataacggtgcgggacggtgttatctgttaatccgccgcctgccggaacacggaagccataaacggacagggggaggggctgccccttctcccctatccgttttgtttcatccaggcaagcacctcatcccaatccctgacctttgtattttgcatccagtcatagaaaaggcctttcagcctgtccgacgtctctttttcttccgccgcaatatcatgcagctccgtcctgtccctgtccatatcatacagttcaaacgggcccggatatttcctgaccagcttatactttcccagacggacgccgcagtttccttcatgctcccagtaaatcggcctttcccgttcccattcccttccctcttccatattcccggcaaaactcgccgccaggctttccccctgaaggggaatcaaggtcttatccccttttttatcagggtaccttcctcccgccagctctaagagtgtgggaaagatatcgataaaatgcaccggtgtatgccgcagaacccctttttcccggattcctttcttccactgcaccacaaagggagacgcaatcccgccctcatggatccagtgcttgaacagacggaaaggcgtattgctcacattggcccagggaaggccataactgatgtatgtatcctctccgccggggcgtttcctcgtctggtttcccacagccacaggcctgccgtccagggtcatgtcttccgcaaaattcatcacccagccgtccgacggaagctcctcggcacaggctccgttatccgaaaggaaaagaaataccgtatcctcctcttccccggtatcctgcaccgcatccattatctgtcctaccgccctgtccatttccatcacctgggcggcatacaccgccatcttgatatcctcccagtctttctcctccacgctgtcccaatccggagactccccatccctcggcgacatatcccagatatcccggacaagccccatctccacctgccggcggtaccgctgtctgcggacctcatcccagccgcacagataagagccttcccgttcccggatatccttttccctggcatgcaggggccagtggggcgcattgaatgccacataaaggaaatacggattcccgccgccggaaaactgcctgatatattcacagcttttttccgctattttttccgtatagtaaaagtcctcggaaggctttacagaaagccatttcccgtcctccgtcaaggtgaccggattataataattccccgcgccctccagcgtgccgtaaaaccggtcaaatcctctctgaaggggggtgggatagccttcctgcccttctatgcttccggcttcctcccggtgtccgtactcgcctcccacatgccactttcccaccattcctgtccggtaaccgcagtttttcagtccttccgccagggtaaggcagttttcattcagatagccctgatattcgggaatcccgatattgccggtcatgtgccccacccccgcctgatgagggtacagccctgtcagaagggacgcgcggctcggacagcatctcgcgttgctgtacatctgggtatagcgcagaccgcaggccgccatgcgatcgataccgggcgtcggtatttcagaaccatagcacccgatatcggaaaatcccatatcatccgccagaaacaatattatattaggtcttttttcctctttcataagccccttcccttattccatggcttcctcagccgctttttcaaacagcagctcattctcttccggcgtcagctctcttcccgtatattcacggaaccgcgcctggaaatccttctgccagctttcggcattaaaaagcgctgtcagggccgccccggatttttccggattatccgaagcatgccggatttcctgtataagccgttcggcacgctctccttcataaaatttctgcatctggtaattggcccaataatggaattttccccttatggaaccatgataaggctcatagggaaccggcacaaaatcaccgtttcggatattgccttccggcccgcactcctgttcgtaaagcaaagcttccctgcgcaggcggctgactgtttcccggatatgcccttccttttcctccgccagattatgctcttccccgccgtcgtccctcatatcgtacaattcttcatacccgccattgtaatggaaaacatatttatacctgtcattcctgcacatcacccaacgccggtatcccaggccggaagaagaaaactggaattcccgatcattcttctccgccagccggaaaagggattctccccgcagctccccgtccggataggcaagtccgcagacatccaggcaggtgggcagcagatcgaagctatccacaaagcctccaatttttcttcctcccgcaagcctctttggataacgcagaagcaaaggcacgcgcacagagccttcataagccagttctttactgtaataccccttatcctgcagcatttccccatgatcggaggtgaaaatgataagcgtattgtccagaagccctttctcccgcagagcatccagaatctttcccactgccatatccaccatgctcacagccgtataataggctttccttatcgcttccttctgttccctgctgtcccaatccccgaaccagggattcggctcattgccgtccatcggcatccgggaacggggaaccggttccggaatcacagcctcccggtacaggccgtccagctctttcggaatattccagggcggatgcggctgaatgaacccgcacatgaggaagaacggctcctctccgttttcttccagccactgtatgcttctgtcagccacccacatggtcccgtgatcctcaagcttctgaaccgaattctgcggtacatgatacaaaagcggcctgaccccatgctggttctggatatccccaagccctttctccttcagatactgcaggtactgatcatcctgccttcttttgggcagctcctccatcaggtacatttccccgaagccatgatgctcccttgcaggaaaaaaatgcattttccctaccgccgccgtcctgtagccgttctcgctgaaaatacggggaagagtgggcgtggcataattatcgatgggcttttcttccagattggtataatagccatgatcccggcccggacgccctgtaagcaaatcatgcctgcatgccatacatacagggttcgtggaatggcactgttcaaaaagaaccccttccccggccagccgatccagattcggggtatgcatatggggaaagcctgccaccccgatggtatcataccgctgctgatccgaaagaagcagcagcacattcggccttttcttcgttttttcttccatcctgttctcctttttataagctttgccgccgctcatcccttgactgcccctatcataacccctttttcaaagtacttctgtacaaaaggataaacacagaggatgggcagagtggacacaataattaccgcatattttacctgatccgcactgtcctgggcatagcctccctgaatccctccgtttcctcccgaaaaggcttcattcagaagcagtatcctacgcagcacgatctgcagcggatcgttggctccgttgttattaaaaatcagggcgttaaaataatcattccaatgggctaccgcataatacaggagcagaacggatatcagcgccttggacagcggaagcactaccttcgtgaaataagagacatgagagcatccgtccagaatggccgcctcatataaatcctccggtatggaattggagataaacgtcctcgctatgatcagattataaatattaatcgccatatatacaatcaatatcgctttggtgcttatcagatgcagggagcttaccgtcatataaagcggcaccaggccgccgctgaagaacatggtaaaaacaaaataaagcatcaccttatccgccatgcggaaatccttacgggaaagggcataggccgcaggcagcgtcaccgccatattcagcatggttccggctgtcacatagagaatcgtgttagcataccccttccaaatcctcgcatcgttcagaatctgttcatagccgtaaaaacggatatccttcggaaggaacgttacctttcccagattgaccaggttggaattgctgacagaggcgataacgacaaaccataggggatatgcgataatgataaaaatcacaatgctgagcacaataacggcagcggaaaaaatggtatccggccagtaaatcttttttctttttgttttcaatttttatcctttctgtctgcgtctttcccgcagacgtaaatgcagatatcagctacagcaatccgtttccggtcgtcctcttggcgatatggttggtcaccagcaggaataaaaagttgattatgttattaaaaagccctaccgcagcgccgaaggaaaactgggatgatttgattcccacagaatatacataggtggaaatcacctggctcgcccccagattcagactgttctgcatcagatagattttatcaaagcccaccgcaaggatatgtcccatattcataatcagcagtatgataaccgtgggaagaatcgccgggaaatcgatattccacatggtctgccatttattcgccccgtcaattctgcaggcatcatacagctgggtatccacggaagacagcgcggcgatatagataatgctgttccaccccatactctgccatacccccgacagcacatataccggaacgaaagccttttccgaacccagaaggttggtattttccgccgccagatgaatgcttttcaggaagttccccaccacaccgctgtcattggccagcataatattaagcatcgataccagtaccaccaccgaaataaaataagggatataaaccgtggtctgcaccgtacgtttccattttttatttctgatctgattgatcatcatagccaggatgatcggggccggaaaacccacaataatgctgaccgcagagatcacaaacgtatttttcagtgtcgtaaggaacatggggctggaaaaatactgattaaaatatttcatccccacaaactcccctccggtaattccggccaaaaagctgtattcccggaacgccagctgcattccgtacatcggtatatagcagaaaataaatacatatataacagccgggaaaagcatgagccacagctgataattctttttccagtattttgccttccttttcatagcacgcctctctttacatgcgggactgtccctttacagtgaaaaaggaacagtccctgcaggattatttattcagatattcctcaaatgccgcctggcggatttccaatatctgaggaagtcccgcgtcattcacattctgcacataggtatcccaatccttgtcaatatccgattccccggtaagccacagggaccaataattatcaataatgttattgatattcgcctgggtaagggccatggtattctgatcctcatccgtatacttcataaacatctgcggataatagtcggattcccccattttattcaggaccgcgtcatagtcttttctttcttccacggcaaaggtcatatcctgtgccatttccagctccgtacttctgcggatatacatagggccgttccctgcgaaggcattcgtccatttccaggtacccggatccatatccgcatccagaggaggaagcaccttaaaggaatgatcgcctgtctgctccacacagccatccgtaattcccccgaacaatacctgtacactggcagcctcatcataaaaggtatcgatgaaacgcatggctgcttcaggatttttacatttggcgctcatacagatcctgttcgcggacatattcagcccggaataatcatttctccagcgggtatcataggttcccggctcacaatccacatcataggcaagaggggcaagcggcacatactgggtatacagcttcggcccgaatttatcggtttcttcccagccgaaggctacacccaccagagcgtttccgtcctcgtcgccccgggacagggactgataggtggaataatcacttgtcagcgctttctggttaatgagtccttccttatacaattcagacataaatcggaggaaatcacggtatctttcatccaccgcatagcattttacctttccgtcctccgcaaaatagccttcctgcccccagttcgtaagctgtattcccgtagcccccagcaggttcgtcagggaataggcgctgttgaaccatgcgttgttgcctccgtatgcattaaagtccagcgggacctcatcatccggattcccgtttccgttggcatcctgctccttaaaagctttcagaacctccttaagctccataaaggtttccggcatttccagccccagattatccagccattccttattaataaacatgaccgtattcgtggccggccatttcccctggaatttaggtgcggcaaatattttatcttcctttgtcgttgccagaatcctggtatccggttcctcctcaaacatctgcataacattaggcgcattttcctctatcagcgaagacaattccataaacaaaccattatactttgtataatcggaatccaccgtggcattaatcaggatatccggtatatccccggaagcaaaccgtgtggacttggtagtttcccaatccgaataaatctgctcccattcaatatccacatttgctttctcttccaactcctgcagccactgcagttcattcatatccttggttaaggaatgtgacacataaagccccgtcaatttcacggcctccccattcccgctctcctgtgcatttccgtccgcctgcgtttccttcccgtttacagcagatgtattttccgaatttccgctttcctgcgaaccgcagccccccagcggaagcgccagcatacataccgacagcagaagtgcaattactttccttctcataccatttcctcctgaattcattcttcgttttttgcttcgtatcctgtatcagttcattctgctgcagcacttctgaacctgaaaccagtctatccctccctcaccgcatttgtaaatatcgcatatttcaagcgtgccaattttgaatatcaccgtcatttttaccatcttattccatgttttcaaaatcagccgctttcaatattgtaccctttcaccatatttcatcgttttttgcatcccgcagtaccgcaaaaggacacaggaaaaggagccggtcggatgaacaacgagacaatcatggataataacagaaactattggaatgaaaatgcagacctgtggtttggaaccactgcattacccgaatatggggtgaaatttgtgacggaggatgacttacatttatttggaaatgtttccgggaaaaagctgctggcatacccatttacagctttgctcaatcctcattaccggaaaaagaccatcacttttattacagaaagccagaccggaaatctatgttctcattttccggtctggctttttactcatatctacctcattttagcatcccattcattgagaatgcctgcaataagagcgtattgttaagcccgtgaatacaggaatttccaccagggccgccacaagaatcacgtaaggcgtccatacacagcggcttccaatatgcaggaaattaaaatccgtcatttctgaagcaaaccctcccaatattgagacacccccggaaggcagcaggcaccgtaaccaggatattccattcccgccggatgccataaataaaataatgggactcaggaaaaacagcagggccaatgccagcgccgccaccgtattttggcaccgtgaagacagaaacagggtaaagctgacagaagccagcaggcttgcgaacccggctgccgccacagccagctgcagctgcccgatagtcatggcgctcaggctcacggtagaaaagaccagctgcatggagctttttaaaaaatcccagccaaaaaagctgttggaaaggatcaggtgcagggccatgcacagggcaaaggaaacagctgtaatcagcaccgccgcggccagcttgatcaccgccagctttcccttcccgtatttggcgcagcgcaggatatcatcggcatgcgtctgatattctgcggaataaatcggggcggcgataattacgcagagcagcaccagaagaaaaatagtcagcatctgataatcataggcattggtgctgtagcccggataaaaaacaaatggcatttttacctttgcatacatcttttccgccttttcccccgcctccggataatccctttgctccagcttcatcaggtttttcaggtgaaccgggcagctctcataaaaatgatccagccaatccggatccagggcggcaattcccggggccatacctgtttccgcatccgcatatacctccggtactctggaaagcaatggggcgacaggaaggattttttccacatacacctccgtaggcagctggtacatgtattctttctcatattctctcaatacccggacagcagtctccgccgcggccttcagctgtgcttccgtgatttctccggctattcctgcctgagcctgtctttttacccgaatcgcatcaaatcctgtgagctctttttccaccccatcctccacgacgttccgtgtttcaaaagtcaccggcagccaggccatcagtacggatataagaagggccgccgcaagcagaatccaggtggtccgtgtctttataaccctttttaattccagcctgaataatctcatcttcttttccctcctttggtacctctctcttctgttttccgtccatctgtattctgagggaaaagccagagatacagatcctccagcctgggttcctccgaaacagaatcctccgtttccggtctgtctcccagataacgaatggtaatatcgccgtccggctcatttttcagattaacaatgcacagctttttctcataatccgccagcgcgcgtgcagggattttttcagaaaagacctttccctccatgcgttttaccaattccggtgtcgttccggtttctatgatttttccatccttcataaccgcatttttcatggcgatgtactccacatccggcacaatatgtgtggatatgagtacaatcctgtcatgggcgaactcggaaagcaggttgcggaaccgcactctttcccccggatccagcccgctggtaggctcgtccagaatcaggatttccggctcattcagcagcgcctgggcgatgcccacccgccttttcatccctccggagagcctgacaatctttttattcttcacttcctccagggtgagcgtttccagaagctcccctatttttctgcgggaccagcccggcttcagcccctttaaggccgccatatattccagataatccctgactgtaaattccgggtagaagccgaattcctgcggcagatacccgaatatatcccggtaagcctcacccaggctgtctatccgtattccatcataggtaatccgccccttatccggctttaatatccccgctatcatccgcatcagcgttgtttttccggccccgttggcgccaagcagcccccatacgcccggagttatccgcagggagacatcgtccaccgccctgttatcctgaaaactcttactcacctgttccaaacacaattccataataacctcgattcccgaaaagccctccggcctctctttttttgtcggttcgcccctgaaggcagcagcctgcctgatttcagcgactgctgcaaggcagtaaaacacagccaacactaaatcccgcagggcatataagccatacgcagccggctgtactgccgtgccaaaaatacaagaaggcagaggcacaccaaggcccagccggccgtaaaggattgaaggtaaaaggccggataatatttactaaaaatcccgaatacaagaagcaggacggcacatgcactcacactgccgggaagaacatgtctccattccaaatgccccagcagataaaacaataccgccgccgccgacaaaaatggcgccaccagatacaataccgcgcttccgtatcccaacggcgttatacggaccgtcagaaaaatcaaaacactgagcccgataccgtcccctatccctgcaaatacaatccaggatgccatcagtttacccgatgacatctttgcggccgcctccacctcgtacatccggcagcgcagggatctttgcaggaaggggagcactgtcatggcgatcaaaactgcgctgcagcagagcaggaacggaatcttatcacggcttattccgtaagaatccccgtatatccttgaaatcaggccgcccactgctgtaaacagcatcgcctggagaagccatatcttccatccggcaaacttaagctgcagcaaaaggaattccccaaaaccggttctttcccgtatgtttcttttcccaccggcctgccgtacggctgccatggttctttccaatcctccgcagtccctgacgtttttttctgttttcaattcctcgccaagccgtttcttccagttatatcccattctttcctcctccttcctgaatctctttttttatctgctttaatgccctgcgaagtctggactgcaccgtccgcaggggaagctgaagcaccagaccgatttcccgcagagtcagttcctgggcaaaacgcagcagtacaatttccttccattcctccggaagcctttccaccaacagtccgaaatccacctccgcttccgcccgtacaaattccggttctgtaaattccacttcctcgggtaaaggctccgccttctttttccgccattcatccacacaggtattcgctgctatctgatatagaaaaggcctgaatttccctttatgctcatacctgtccaaaaaacggatcgccttcagaaaggtttcctgcgccgcatcctccgccgccatccggtcagggacatgccacaggcaatacctcagtatttccggataatacagcttcaccagctcctccggtgcattttcatcaccctgcttcagttttttgaatatttcatcttcacgcgtcaagtctttcctcctgagggcgtcccctccggcttctgtccggccttctctttatataacgcaggaacaaggggtaaatgatttcatttttataaaaaatggcaggtattccgttacctgccacccttcttactccctgttccgtatattctttctgtattctcccggcgtcatcccgcaatgctttttgaaaacccttccaaatccgttggccgtggaataccccaccgcagtcgctgttttctccagcggttcctccgaatgctccagcaattccttcgccttttccacccgaaggcgttccagccatgtggaaaaattcacgcccgtggaatttttaaaatagtggctcatattggaataagtcatcccgaatttttccgccgccgactgaagagaaagattataatccccgaaattctcctccatatagcggaaaacatcctggatatccatatcctctccctcttttggctcttccttatcccagagctgggaaagctgggcggccagcgaggcaaatgcctgttccatcatggcataatccatctttttcttgtctgcgatcgtataaatatattcctttttctctcctctggcattcagttccctggaaagaaggttatacatattacgataaactactttataggtttcttccgcctctctcagcccttccagatatttcaccatccggcccgtgcagttgagaagctccgtcctgcttttccgcaaaatggcgatttccagatgccggccgcattcaaagacttcatccagattctccacccgtttcacttccatactgtcataattcaccatggccggcctttttcttgttcttgcatactctatcgccgccacactgagcatataggaagtatggatatccgccaatgctgcacttcgcccaatccccacataaagaggaagcttctcagcctgataaatttcccggaacgccgtcatccactgttcctggattttcccgtttttaaaggtcaccaacagcgtttcatattccttattcagcccttccggacggtagcagaagaacatttccgcttccttttccccattatccgcttccgtctttcccctttggttcaccttttccagaagcgaggtgacctgctgccgctgtgcttccctgtccgtcccctggcagacgatacagcaattcagcgaaaacagccgcaccgaacaatcctccgcattttccatgacctgttcttcttccgtaaaaacgcctcccagacattgggtgaaaaaatagttcttcagctgttcttccctggttgataccttctttttcataagcagaaacggtttatagctgatatgggcaagcccccatatcaaaacagtgccgccggccagaagcgctacaaataaaaacagggtattgcggctgacctggttcatcccctgctgtattttgcttttatcctggataatgacatatttcatatcataataattggaatccagagatgaaatcagatacggcccgtcttcctttcccttctcatccgcctcttcgttcccatatgtttccaccagttctgtgatatcctcattcttaagccccctgtcatgggcagacacggcaatcggcctgtttttttcatccagaaccgcaaaaaaacttccttcatccccttccgcctgcagggaactcatatcggaaaacagatttttctctcttatcagcacaatcagcaccagctcggcgcggggatttcccaccggcacgggcaggctgacggtgatcatgtcattcatcagcgtctgattaataaaaacaggctccgccttcctgacatccatctgcttcaaaccgagataataagtcataaacgcttccttatcccaattatcatagtaaaaggtgctgccgggattattcatttcccaggaagaaaaaatagcgtccgtcccgaagaacagcccgtcattccggttgaaaagaagcactttttccgggaacggattggttcccacgattttcttcagctccatctggagcagataatggtcataggggcttccgccatggagcatcctcggcgagatatcgggatccttcaggattgccgaaggataattggatatcatacggaactgggtatccaccgaatttttcaaaagcataagagaatgattccccgctatgacagccctctcattcatatttctgctgacagccggataaaaatagaccagcataaccatgacaggcagcaaaaacacaatgacataagaaaaaaggaatttcaaataactgcctttccgtctttccttcccattcatttatgccccctcctgccggtaccgttccagctcattctgataaatttccatcatttcctcaaggcccaggctcctgatctcctgcagatactcctcccattcttcctcaatcccgccgtatgcaatccattttacccacttttcatccacaagcttcaaaatacctgttttaattatggcgagacggtccgcctcttccttggtaaatttcagtctcggcaggatatcctcctccggctggaaatagggttcatactgcctgtactgctccaggctcagggcaatggaggccggaggctttaaacggctgtcaagctcatctgatgcaaaacatacggcgttgcctcccagggagttaatccacttccactcatccgccgtcttacctcccggtgcaggcagtacctcatagccatcctccgttttctccacaccgataccgaaggaaccatagatagcctgtacggaaaattcttctccatacatttcattaatccagcgcatggtttcttccggatagggattattcgcggttaccaccacacggtttgtctcatatttacaccgcgccggatgggagggccagaagggttccgtttcttcggaagcccggagcggcagaagcacctgatagctgtccgcataatccgggccaacccgatcctctatggaccagcccagcgtggcccccaccgtcatagcggccggatttttggatttctgctggaactgggaataatcctggctgaacacctccggattgatcaggccttcctcaaacagactgtgcaggtagcctgtcagctgataatattcctccgtaaccggcaggaacagaatctctccctgcgccatgccaaaccattctcccgaaaaatcttccgcacatctcccataggcccctatcaggttcatcgccgtaaacaatcccctgttattggaaaaatcaaagggaatttcatccgctttcccgtttccattaggatccccgtcccggaaagccctgagcacatccctgaattcctccagtgtccgcggcgtttccaatcccagggcatccagccagtcctgattaatcatcatcatggaggtgctgtccggcctgtggaacttcaccgagggaagcccataaatattcccgtccgtaaaaacggccagcattcttgtatccggcttttcttcaaacattctcatcacattgggagcctgttcctccacgtaatcgttcagcggaaggaacagctccggataggctgaaatatccgcatccgtaatggccccgcccagaaaaacatccggcacatccccgctggaaagaatggcatttttcttctcctcccagccggaacggacctgttcccaaaccacctttaccccggttttctcactcagctcctgaaagctgggaatatcctctatatccttcgtccatgcatgcgtcgtcaccagaacatggattaccgcttcctcctgtcctatatccgtttccttttctccttccggctccccaccgcccgccagaccgcaggccgccgtcattcctgccagacacaatgccatcagtatactgcacacttttatccttttttgttttctccccatattacatgccccgctctcaaatttcatttttctcactatcattgtatagaaaaaaagccggataagcaacgcccgcttccaactcctgcccggaaatccggcaaatgtgccttcccgcgtcttctttggcggctgtcatccccttttattatgcacattgcatatttttgttgaatcgatctgtgtcttttgtatattttcatatttgctgttgataaaatgagtttttttatcaaatttcacagaaattttatggtacgtgccatggatttatggtaaaatattaaaatcattgctagtcatctgcctttttctcaaatatcaggcagctcatgtattgacagctggaaaaaattaatgttaagcagggttatcctgcggacagctgccgggattcttttcccgccgtcatttgggtcagacctgaaatgccggccgccttttatttcccacagctttgtcctcacgaacgaaaggagttcacatgttaacgcaagaagaaatcaccagcctcgatgagattctttcaagccatgattacgacagctcttccgttatcgcagtcatgcaggacattcagaagaaatatcgttatcttcccgaagacgcgctgacctatattgcagggaagctgaagctgagcgaagccaaaatttatggtgtagccaccttttatgaaaatttttcactggaacccaagggcagatatgtcatcaaggtgtgtgacggcaccgcctgccatgtccgtaaatcaatccccattttggaagaattccggaatatcctgggcttgtccgaaaccaagcataattcggatgacatgctttttaccctggaaaccgtctcctgtctgggagcctgcggcctggcgccggtatgcaccgtcaatgacaaggttcatgctgccatgacaccggaaaaagcacgggaactcataaaagaactgatggaggaagcagccaatgaaaattaacagccgcgaagaattaaaccacttgcaggaatactacagcagccgtctgaacgcacagaaaaaaagaattctggtatgcgcaggcaccggctgtgtcgcaggcggctcccttctgatatatgaccgcctgaaagagcttatggaagaaaaagggatctgctgtgaggttgtcctggaagaagaaccccatgatccttcccttcattccgcatctgccggtaccgacggctgctgcgcggaaggaaaagaacccatcggattaaagaaaagcggctgccacggcttctgtgaaatgggcccgctgctgcgtatcgatccggaaggccttctgtacataaaagttaaagtggaagactgtgaagaaatcatcgaaaaaagcatcctgaaggatgaaatcgtggatcatcttgtttatcaggatcattccctcaaatcctatcccaaacaggaagacattcccttttataaaaaacagacccgtgttgccctggaatactgcggacatattaatgcggaatccgtaagggaatatatcggagtaggcggctacagcgccgtggccaaagccctgtttgacatgactccccaacagattgtggacgaaatcacagaatcctgtctgcgcggaagagggggcggaggattccccaccggccggaaatgggcacaggttctccgtcagacagaagaaaccaaatatgttgtctgcaacggtgacgaaggggatccgggcgcattcatggatcgttccatgatggaaggcgagcctcaccgtgtgctggaaggcatgatcatagccggtatcgccacaggcgcacattatggctatatctatgtgcgtgcggaatacccgctggccgtatcaagacttcagactgccattgatcaggccatggaaatcggtctcctcggcgacaacattctgggatccggttttggtttcaccgtaaaaatcagccagggagccggcgctttcgtatgcggcgagggcagcgcccttacctcttctattgaaggaaaccgcggcatgcccagagtaaagccccccagaaccgtggaaaagggactttttgaaaagcccaccgttttgaataacgtggaaaccttctgtaacgtagctcccattatcctcaagggcgcggaatggtacaagactatgggcccggcaaacaatcacggcaccaaagctttcgcccttacgggaaatgtcaataataccggactgattgaggttcccatgggaaccaccctccgggaggttattttcgatatcggcggcggtgtaaagggcggcaatttcaaagccgttcagatcggcggtccctccggcggctgtctgtgcatcagtgctaccgaagatcacctggatatgcacctggattttgattccctcaaaagagtcggcgccatgatcggttccggcggccttgttgtcatgaatgacaagagctgtatggtggaagtggcccgtttcttcatgaacttcacccaaaacgaatcctgcggcaaatgcgttccctgccgggaaggcacaaagcgcatgctggagcttctcacggatatcacagaaggcagaggaaccatggagcacctggatatgctggaagagctttcacagaccatttccgacaccgccctgtgcggactcggtaaaacagccgctttcccggttgtcagcaccatgaaatatttccgggatgaatatatttcccatgttgtggataagaaatgtcctgcaggacaatgcaaagcgctcatcaacctgcagattgatcccgagctgtgcaagggctgtaccaagtgtgcaaggctctgccccgtttccgctatctcaggggagctgaagaagcctcataccattgatgtcagcaaatgtatcaagtgcggcgcctgcaaggatggctgcccgttccatgcaatttattaatttcaaatagtttatgattgcatacgagaagcataaaggagaatctgaaatggcaaaatatatgattattgacggcataagggcggatttcgaccaggaaaaaaatatcctgcaggttatcaacagcataggtatccatgttcccaccctttgctattattccgacctttccatttacggcgcctgccgtatgtgtatggttgaggacgagcggggcaatttaatcgcctcctgctccacccctcccaaggataaaatgtccatccgtaccaatcccccccgcctgcagcatcaccgcaagatgattctggagctgctgctggcctcccactgcagggactgtaccatctgtgaaaagaaccagacctgccgccttcaggaactggcaagccgtctgggcctgacggacgtccgtttccccaataccagaaagccccagcctgtagataattcctccgtatctatcgtgagggatcccagcaaatgtattctctgcggcgactgcgtaagagtctgcaacgaagtacagcatgtgggagccatcgattttgcagaacgcggctcttccatggtggttactcccgccttcggcaagaagctggcggaaaccgactgcgtaaactgcggccagtgtgccgccgtatgtcctaccgctgccatcaaagtaaaaaccgatatggataaggtatggcgcagcctctatgatccttccaaacgtgtagttgtacaggtagcccccgctgtccgcgtcgctctgggtgaagccttcggcctccagcccggcgaagacagcatcggcaggattttcaccgccatccgcatgcttggttttgatgcggtatatgatacctgtgtcggcgccgacctgaccattatggaagaggcaaaagagctggctgaaaagctggagagcggtgatgaccgtttccctctgttcacctcctgctgccctgcctggatccgttttgcagagacccgccatcctgatattttaccttatatctccacctgtaaatcacccatggaaatgttcggcgcggttttaaaagaatattataaggaaaaagacgcggaagaagaaaagtctactatttctgttgccatcatgccctgtgtggctaagaaaatggaggctgtccgggaagaattcaaacgggacggcatccctgatgtcgactacgtaatcacaacaaaagagctgatccgcatgatccgtgaaagcggcatccagtttgatgaaattgatcccgaagctcccgacatgcccttctccatttcctccggtgcaggcgttattttcggcgtgaccggcggtgttaccgaggcagccctgcgccgccttgtacaggagaaaagcacccaggcgcttcgtgacatcaaattctccggtatccgcggtatggaaggcgtaaaagaagccctcctggaattgaacggccgtactctgcgcattggtgtggtaagcggtctcggaaacgcggacgatctgattgaaaaaatcaagagcggagaagaacattttgactttgtagaggttatggcatgcccttacggctgtattgccggagccggccagcccttctgccacaaggtggataagaaagaacgtatcgatggcatgtaccgttccgataaagcggctcccatcaaacgaagtgaagaaaatcctgttatttatactctatataataatggcggactgctggaaggcagagaacatgaactgcttcatgttcattatgccggcgcgcatgctcatgaataaaacagcccgttaacggaaggaaagcctatggtaatcacaccgaattttcatttccatggtgactgcgaagatgccatgaaactgtatcagaaggccttcagcggagaaatcacctgccttctgcgctaccaggatgccaatccacaggattatgtcgctgacagccgatggggcagccgtatttatcatggcgaaatgcttctttatggcatacgggtaatgatgtcggatctggaacctgcggaagcggaaaataagccggaatcaccgccgctatcccttgtggtaactatggatacgaaagagcaggtcatggaagcctatcaggccatgatggaaggggcgttgatccgtgaacagccccaaagtactacctacagttcctgctttgtttccctggtcgatcgatttggaatccggtgggaaattatgacggaacagaccttgcaataaacatggaaaaggagcttgccgaactttttatttggttcggcagactcctttcaaaaaaatatctgtctgctgaatattggtgttctaaaataaaatcagatcttaataagtcggtgcagtttcgtatgttcgggctacattttgacaatctcttgtcctttctctctttagtaattcatctatcataaattccatatataatttactgtacttgcagagttgatattattacaataccaatctgctgcgtcccttcatactctttttctttgatagaatttaatgtttctatgtctgtctttttcaccgcacaatgtaactctccaatcataagtttatccagccggcattttcaaatatattcagccagtcactttaaagtcattaatacggaaccataaagaaatatactaattgaaaatagcacaaaagaggaaactatataattaatgaatattgatttaataaaaactcaacaatatttagaatggttaaaagataaattatatttaaacgctatttcatcctccgccaaaaatcgaacggtatatcgaggtcaggtataccgctgtaattttggtgttggtataggcagtgaagaatgcaaggaaagaccctgcgtaattcttcagtacaattctgcaaataaaacttctcctaatgtactcgtcgctccaattacgcatactgcctcaaagttacctgttgttgtaccaatagaaaataaaaaggattctgccagcaatactctgcttgatggcaatgttctgcttggtaatatcacctgcgtaagcaaagcccggcttggagactatattactgaactcacagccgcagaaatgaaagaagtcgacaaagcaatttctttatcccttgacgtttatcattactatcaaaccatactgaatatttacaatgataaacttttgtatatcgataagctgaaagaacacaatacaactactcaaaaaaagctggatactatgcaggaaactataaatcaaatcaatcaactgcttaagcaatacaattttgtaaatatctgtgaactatctgaattccttgaaaaatcaaacgcaaaaaagtagacaaaaaaagaatttcatggtagtataagaatacaagaaaagcacttacgtgtaaggtgctgttatagtttttcaagcaagggaactacgtgtgagttccctatatttttatctttgtataaagcaatcacagaatgcatcatctattattataattattccccatcgtaataatcaacctcatccccgagcctgaaaaccttattcacgtccttcccccatataccaattttatcggattccggatagacagccacatccaaatcatgaaccacatcaaagtcaatataaaccaaagtctctgcggcagacgtatttactaatttatgcgccccattcctgtctgcaggaaaaaacaacaaatcgcctgctgttaccttcctttcaccgtcaggagttttcaatatcccttccccgctgataatataaaaagtttcctcatttttaatatgataatgatatggataggccgcttttaacggaggaatttcatagatactcaccatacttttatctgcatggcctcttggcacaaaatcccttttatagtattcatacccttcctgttcggatttatgttttacctttaattcactcacttttgcatgccgcatttcagccatactatacctccctgttttcagttattcaaagggatatcgaattccccactccgcccgcatcccatccaggatatccatcacccggattgtttccgcatgaggcatttccggacattccagcgctcctgtctcaagggctcgaatacaggcttccacttcatattcatacccgcttatctgggccggacgctctatatgctttatctctttatgctctccgtcatataccgtcagactttcaaagttattaatattctcaataaccatacttccttttgtcccgtgaataatacccttccgatcgctgaatacgagcaccgaactgtttataacagccatctttccgtcctcataaaccagtgctgcactgttctgctcatccactccggtatccatataagtacatgtggaggtaaccttggcaatatctgtcccgaatatcatcagtgcaaaattaagcggataaacacctacatccagaagtgctcctccggcaagctccggagtgcgcattctatacgaatccgctgccacatatcccagattggccgtgagaagcttcggttcccctatacttcctgactccagttcctttcggatcgtctgaagcatgggcatgtacctgacccagatagcctccgtaataaaaacaccggccttctctgccatcgctatcagctctctggcctgcttcgcattggccgtaaaggatttttcacatagcaccggctttccatgctgaatgcacagctttgcgtttgcaaaatgctcggaatgaggcgtggcaatataaaccagatccacattttcatccttcaccagttcctcataggatccataggctttctgaaacccatattcctctgcaaatctgtccgctttttcctggcttctggaaccaatggcatatgcttccacattatccatctccgcaatggtctttgccatacagaccgcaatacctcccgctcctataatcgccatcctcatttttttcattttgaaattctccttttctgcctttgcacttatgtctcttttccatatctgcacacccttttcccgaatgaggacaggaatgcccccggattactccccgtaccggtacctcttccggaaagcatcttccaaagcgtccgtttcccatgggaaaatacaatactcaggcgttcctgctgccgctagctccttcagccgttcaaactctatccagcagacaccctccacctcttcctcctgaagcttcagttcctcttccttaacaggcttatcatataaataaaccgcagagatttccctgtccaaaatatggatccctccaaaccattcatccacctgacagggataaattcccccaagaaacaagtcttcttcctttgcttccagccccagttcttcctgcagttcccgcagcgctccctggataaagctgtcccctgcggataaatggccggcacaggaagcatcataacatcccgggaatgtttccttcagtcggctgcgcttctgcagaagcacctcaattttcccattcttccggcgcaccagccagatatgggctgtcccgtgccagtcgccgtccctgtgaaccgcgcttctttcctttacctctcctgttggctccccttccggagtcctgatatcaaacatttccattccttttccctcatacctgtcggtattttcccgtgtaaatattacagcagcccgaaggctgctgcatagaaattcctgttttattgtatcacaaagaaaacatcactggcaaatggtccgtcaccgccgttatacaccttactgtttcccatattgtcggctacagacaccctttttatccggtaggtacccgcttccttcgtctggctctttttgattgtaccggaatagagcatatccccctgataatccaggttaatgctgacagccttaccgttttcattctcaaaacgcaccgctaccgtatccacaccggaaaaatcatccgccaccgcagcagtcaccgtaatctgtgactcctttgcggcctgcacgggggataccgttaccgccccaagcaccggcgctgtatcatccacagccgccacaccatttgtcacagcaaaaccggccgtaaaaggcagcgtctggtatttgtcattttcctctctgtcctcagcgcggcagtatttcagatattctccattattatcctgcagaattaccttatccaatacataattgccggcaggttcataaatactcatcgttatccagccggcataaacgccattggaataatccttatctctcagaattttagtgacactcctgtcattttccaggtttctgaactgtacattgatatgatccaatccagcagcccccggaagcgcctgcacggctacatagatcttcagatccttgccgtccgcagtcatcccgcctgccgcaaccgccccaagaaccattccctgctgaaccattcctgaaccgaccgcttccgccaaagcctgcatccctgtctcctctgccgacacaggcacggagggaagcaaacaggacacagctaaaaccgctgcagccactattcctgtcattccataaaccttcttcatccgctcactcctccttttacctctgaaaaagtgttttttgctctttttcattctatcatatccccggtaaaataaaagaagattttgggatttttgatttctaattccgcatcacagctcagtctgttatataaggcatttccgtcatccgcagattggtgcacccataaggctgaagaaccttctcttccggttcacccatcgcttttctttctgaaggctccacagcacagacaccatatttttcttcccacggtaccttcaccatttttgtcttcaggcagacaggcggttcttccacggaaaaaggataatcccctatcttaccgtggctgatttcaaaactctccgaacagaatccataattccagtctgatacaggcgtgagctcataatcacaatagggcgctttgcgttccaccccatcccgggtatattccaggatacggcactgtgcctcaacagggagtgaaaacacaagcggtccgcgcactgcggctttggcaccgaaaggacgatccaccagcgatgtctcaaatacaaaacgaacaggaatccgggtactgccttcccaggttctgtaaatccggtaaaagcttcccggctccgccttctcctcatcaaccagagcctcttttgcaaacccgggaattcggatcagcagctccatagtcaccggacgctctgcggttacctcaatcaccgcctcatcccggaacggatactccgatactatctgaaactccacttcagcaccatcacgcatcacctttgcctgtacaggaaccatggacatcaccgccagcccctccctgctctgcatcagggcagataatgcaaatttgggccaggcctggttgaaattcgccgtacagcagccaaaattgggttccagcccaaacatatgggcttctcctctattggaattaaaagggactccttcctccggaattctgctgcagctgatctgattggtcatctgcacatactgatgggcccacatatccggagtcgtagttgccggaagacaattaaaggcctctttttccagaagatctccccagaaggaatcccctgccgccgataaaagaacctcgcaggaatacatggcctccgccacgctgcagcattcacttccctgaacaggagaatcgccggacagacattcgtcccctgtgaaatgaccggttgccatgctgttatacttcattatcttttgatacatcttcctggcaaaagcatccccgtcctctcccgtaacaagagacatcagcgccctggatttcagcgccatagccgtatttaccacatgattcagctgcgtccagtatttatccgccgccggatgttcaaaatcaaaatgctcataaagcttttcataatccagcccttccgcgtccagaacatacataagctgaagcatccactcctccggccgtctttcatacagccataataaaggaatcagacattcataccacctggccgctccccagttgaaaagcgtattgtgggtaatgtgatcgagcaggtttttcatagcgcggtaaaccgccggctcaatccgttcatcccccgtacaatcatgataaagcaccaggaccttgcagatcagaaaaacagcccacacatcatatgtatttctctcatccttcccgcagggacagatccatccgtcctcctcctgacgggccaggattgcatcaatatattttcccgctctctttatgagctcctcatcttccagcaaataggccagcggaatgaatccatccagccagtacggcaccctctcccagccttccttgtccccgcctatccacttgctgtcacgaatatccggccaaatcaaatccaggtgccccgaaagcccttccgcctgaatttccagctgccgtttcagccacccctgcggccgaagctcctttgttgtgagcggaacgaattttcttgcttgcatactcttatctccttattttataattttatatttcttttttggtacaaatgttttattctgtaaatacagatatgcctctctgttttcaatccttccctaaaaagaaaggcggtttgccatggaaactattttcctttcccctgcccccatgccgtatctcacagactgcagtctgaagcgcttcggcatcaatgaataccactgctcccgctgctgcggatactttgtcctcattttcatgctgaaaaatactcttcagtttaccgaaaacgggattcttaccacccttcatccgggagaatggtatatccagagaaaaaatatccgtcagaacgcgtcccgcccaagcccgaaggcggaatactactacattcatttcgaagccgcctataccgaggatcgtaccaaccggctcatgctgcctgtccggggaacctttcagcccggccttttcctgccgctccttcagcagctggaacgccttctgaaccggactccgtgcagccatctggaactgcagagcgaattcttcagactgcttggcctgctgtatacccaggaacaatcctatacgccgctcaccgccggcctgatgcgctacctgaatgagaactatgcctcccacataaccggagaatctctggcagaagccttccactattcctccgaatatattgacaaaaaaatgaagcaggagctggggatgactcctcacgcctatctcacctgcattcgtctgcagaatgccaaaaagcttctggaacgcaccgatcttcccattcagaaaatagcttcggaatgcggcttctcggacaattccatattttacaaggcatttaaaaagagcttttccttaagccccagtgaatggcggaaaagaaatcagttcccggatcggcgtaccgataccgtatcttcatcatagtatgaaaccgtttcttttttaagttcaaaaacaggaaaatacattgcaaatctggtactaaaaagagtatgttataaacaggtgaaccgatatatggaaagaaaagaactcgtcaatcaaagcattgactatattatacagcatttagatgaggatttatcgcttgatatcctgtctgcacacttctgcatatcaaaataccacttcagcaggatatttaaggaagaaaccggagaatccatttatgcattcattaaacgctgtaaggttgaccaaagtgcagtcgatatgaagctgaatccggcgaaaacaattacagatattggtctggattacggatatagttctttcaattacagttccgtattcagaaagcgccatgatacttctccgactatatttaagcagacgctgccgtctcacagcatgcctgttccctttgctccggaacacattgtacatttcaagactgcggaggaatatgaggctcaaatccaaatccgtgagcttaatgacttttttgtgatttatgagcggtttatcggaaactacgttgacctcgaaaagaactggtatcagtttttagataaatacaaagagttaacaaacgaacagacaattcttttagaacgtttttttaacgacccgtctattaccaatccggcacaatgcatctgcgacatatgcatgacagcagaacagaattgcggaggggataatgtcatgtggatcagaggcggcaaatttattgtatatcgtttcgacggggagattaaggacatttttgaaatactgcaggggattttcagcatctggcttcctcaaagcggttaccaaatgacacagagatacggactgaatatttatcatcacattgaccggaacaatcatcacgttattatggatttatgtattcctgtttcataaaagcaagaattcagaagtcagaaacatgactttcctctataatctgaaagtatatcacattctttatacccggaaaaaaggaggacgctatgttcgatataagaaaaatacaagaaaacatgatttatgaatctgtcaaagccgaaagcaatgaaagtattgccggagaagtggtttatggcagagaaggtgcggcacaaacagaaacgaatcctgaatgggtaaggtctgccatgcagcgcctggaaaataagtttgattacgataccgtaaagaaaatacgaatgaactgccagtgcggttacggcatggacgaaaaacttgctcttgtaaaggagcttatggcagattcctccagtatagaggaattcacagcttcagagaaggcaaaagccgccggactcttctccaaagacggtgaactttttctgcagtttaatttttgcccctgtcccatgctcgcggaggtggaaaagttagaaagctatacatggtgtcaatgtactgccggttacagcaaagtgctttttgaaaaagcgtttgcctgtaaagcagacgtagagctattgaaaagtataaaaataggtgatcccgtatgccttatgaaaatcactctccatgatcccgtctggcgataaaatctatgatagatcaatatttttctctacactcacggttaagagccggataaccggctcttaatcctttttacagctcccctttggccagcagattgtcttttcccataccgcagacaaactcatttgtatcatatctataacagaaatccaaaaaatcagaacgcagcttcggatccttcattattttcacaagcaattcgttcggtattgtcctcgcatatgcgcccggtcctgccaattcaatatttttcacgcccgacctgctcagtatatctcttaattcatccggcataaatgtatatgtgatacaccagggggctcctccctgttcatattccgctatttccttttcgcctcccataagtccctccgccaacagtttttctgccgctttttcatcaaaagaaaaggacttcacagcgttatccttattggccacacaccaccttacccaggaatcgccgcagttttcatccagaataaactgatttttctgaagcggatttgccagataaggaagatatcccatacggcttgaaacacttatgatgatacgctttccggcaagacggacaagctcctgaatcacctgttcctgatgaggataagtgtatgagatcggagcatcaaaggatatgaccaaatcaaaggatttact
